US009782454B2

(12) United States Patent
Shandler et al.

(10) Patent No.: US 9,782,454 B2
(45) Date of Patent: Oct. 10, 2017

(54) HIGHLY ACTIVE POLYPEPTIDES AND METHODS OF MAKING AND USING THE SAME

(75) Inventors: Scott J. Shandler, Philadelphia, PA (US); Samuel H. Gellman, Madison, WI (US)

(73) Assignee: LONGEVITY BIOTECH, INC., Philadelphia, PA (US)

( * ) Notice: Subject to any disclaimer, the term of this patent is extended or adjusted under 35 U.S.C. 154(b) by 0 days.

(21) Appl. No.: 13/642,757

(22) PCT Filed: Apr. 22, 2011

(86) PCT No.: PCT/US2011/033684
§ 371 (c)(1),
(2), (4) Date: Jan. 2, 2013

(87) PCT Pub. No.: WO2011/133948
PCT Pub. Date: Oct. 27, 2011

(65) Prior Publication Data
US 2013/0096050 A1      Apr. 18, 2013

Related U.S. Application Data

(60) Provisional application No. 61/327,098, filed on Apr. 22, 2010, provisional application No. 61/364,359, filed on Jul. 14, 2010, provisional application No. 61/405,560, filed on Oct. 21, 2010, provisional application No. 61/445,468, filed on Feb. 22, 2011.

(51) Int. Cl.
*A61K 38/00* (2006.01)
*A61K 38/22* (2006.01)
*C07K 14/575* (2006.01)

(52) U.S. Cl.
CPC .... *A61K 38/2278* (2013.01); *C07K 14/57563* (2013.01)

(58) Field of Classification Search
None
See application file for complete search history.

(56) References Cited

U.S. PATENT DOCUMENTS

| | | | |
|---|---|---|---|
| 3,989,816 A | 11/1976 | Rajadhyaksha | |
| 4,316,893 A | 2/1982 | Rajadhyaksha | |
| 4,405,616 A | 9/1983 | Rajadhyaksha | |
| 4,414,148 A | 11/1983 | Jansen et al. | |
| 4,557,934 A | 12/1985 | Cooper | |
| 4,568,343 A | 2/1986 | Leeper et al. | |
| 4,569,789 A | 2/1986 | Blattler et al. | |
| 4,589,071 A | 5/1986 | Yamamuro et al. | |
| 4,659,839 A | 4/1987 | Nicolotti et al. | |
| 4,671,958 A | 6/1987 | Rodwell et al. | |
| 4,680,338 A | 7/1987 | Sundoro | |
| 4,699,784 A | 10/1987 | Shih et al. | |
| 4,783,450 A | 11/1988 | Fawzi et al. | |
| 4,904,584 A | 2/1990 | Shaw | |
| 5,120,712 A | 6/1992 | Habener | |
| 5,188,835 A | 2/1993 | Lindskog et al. | |
| 5,218,092 A | 6/1993 | Sasaki et al. | |
| 5,464,933 A | 11/1995 | Bolognesi et al. | |
| 5,565,486 A | 10/1996 | Renno et al. | |
| 5,595,760 A | 1/1997 | Cherif-Cheikh | |
| 5,656,480 A | 8/1997 | Wild et al. | |
| 5,672,659 A | 9/1997 | Shalaby et al. | |
| 5,677,419 A * | 10/1997 | Bolin et al. | 530/317 |
| 5,686,511 A | 11/1997 | Bobo | |
| 5,739,106 A | 4/1998 | Rink et al. | |
| 5,990,077 A | 11/1999 | Drucker | |
| 5,998,367 A | 12/1999 | Gaeta et al. | |
| 6,007,792 A * | 12/1999 | Dean et al. | 424/1.69 |
| 6,051,555 A | 4/2000 | Hadley | |
| 6,051,557 A | 4/2000 | Drucker | |
| 6,060,585 A | 5/2000 | Gellman et al. | |
| 6,133,418 A | 10/2000 | Bolognesi et al. | |
| 6,136,828 A | 10/2000 | Elliott | |
| 6,184,201 B1 | 2/2001 | Drucker et al. | |

(Continued)

FOREIGN PATENT DOCUMENTS

| | | |
|---|---|---|
| EP | 0188256 A2 | 7/1986 |
| EP | 0699686 | 3/1996 |
| EP | 0708179 | 4/1996 |
| WO | 87/06941 | 11/1984 |
| WO | 90/11296 | 10/1990 |
| WO | 91/11457 | 8/1991 |
| WO | 97/39031 | 10/1997 |
| WO | 99/03887 | 1/1999 |
| WO | 99/07404 | 2/1999 |
| WO | 99/25727 | 5/1999 |
| WO | 99/25728 | 5/1999 |
| WO | 99/67291 | 12/1999 |
| WO | 00/26354 A1 | 5/2000 |
| WO | 01/00224 A1 | 1/2001 |
| WO | 02/47712 | 6/2002 |

OTHER PUBLICATIONS

Gaudin et al, The human vasoactive intestinal Peptide/Pituitary adenylate cyclase activating peptide receptor 1 (VPAC1): constitutive activation by mutations at threonine 343, Biochem Biophys Res Commun, Jan. 8, 1999;254(1):15-20.*

(Continued)

*Primary Examiner* — James H Alstrum Acevedo
*Assistant Examiner* — Sergio Coffa
(74) *Attorney, Agent, or Firm* — Pepper Hamilton LLP

(57) ABSTRACT

This invention relates to novel compositions comprising analogs of naturally occurring polypeptides, wherein the analog comprises an α-amino acid and at least one β-amino acid. Administration of the compositions may be used for effecting treatment or prevention of a plurality of disease states caused by dysfunctional biochemical or biological pathways. The compositions and methods of this invention are particularly useful to identify novel therapeutic modulators of in-vivo receptor activity with extended half-lives and relevant bioactivity as compared to the naturally translated polypeptides upon which the analogs are derived.

12 Claims, 4 Drawing Sheets

(56) References Cited

U.S. PATENT DOCUMENTS

| | | | |
|---|---|---|---|
| 6,218,410 B1 | 4/2001 | Uehata et al. | |
| 6,258,782 B1 | 7/2001 | Barney et al. | |
| 6,348,568 B1 | 2/2002 | Barney et al. | |
| 6,462,016 B1 | 10/2002 | Wakita et al. | |
| 6,562,787 B1 | 5/2003 | Barney et al. | |
| 6,608,174 B1 | 8/2003 | Burman et al. | |
| 6,656,906 B1 | 12/2003 | Barney et al. | |
| 6,683,154 B1 | 1/2004 | Gellman et al. | |
| 6,710,186 B2 | 3/2004 | Gellman et al. | |
| 6,727,368 B1 | 4/2004 | Gellman et al. | |
| 6,750,008 B1 | 6/2004 | Jeffs et al. | |
| 6,824,783 B1 | 11/2004 | Bolognesi et al. | |
| 6,849,714 B1 | 2/2005 | Bridon et al. | |
| 6,858,580 B2 | 2/2005 | Ekwuribe et al. | |
| 6,861,059 B2 | 3/2005 | Johnson et al. | |
| 6,958,384 B2 | 10/2005 | Gellman et al. | |
| 7,186,692 B2 | 3/2007 | Quay et al. | |
| 7,504,409 B2 * | 3/2009 | Zhou et al. | 514/266.4 |
| 7,723,288 B2 | 5/2010 | During et al. | |
| 8,273,713 B2 | 9/2012 | Pittner et al. | |
| 2002/0037997 A1 | 3/2002 | Gellman et al. | |
| 2002/0132766 A1 | 9/2002 | DeGrado et al. | |
| 2005/0288228 A1 | 12/2005 | Cundy et al. | |
| 2007/0224273 A1 | 9/2007 | Xu et al. | |
| 2009/0143283 A1 | 6/2009 | Clairmont et al. | |
| 2010/0048871 A1 | 2/2010 | Cho et al. | |

OTHER PUBLICATIONS

Stark et al, Liposomal vasoactive intestinal peptide for lung application: Protection from proteolytic degradation, Eur J Pharm Biopharm, Sep. 2008;70(1):153-64.*

Lesma et al, An efficient enantioselective approach to cyclic b-amino acid derivatives via olefin metathesis reactions, J Org Chem, 2006, 71, 3317-3320.*

Miller, The Enantioselective Synthesis of Conformationally Constrained Cyclic β-Amino Acids, Mini-Reviews in Organic Chemistry, vol. 2, No. 1, Jan. 2005.*

Rampelbergh et al, Characterization of a novel VPAC1 selective agonist and identi® cation of the receptor domains implicated in the carboxyl-terminal peptide recognition, British Journal of Pharmacology (2000) 130, 819-826.*

Eberlein, G., et al., "A new molecular form of PYY: structural characterization of human PYY(3-36) and PYY(1-36)," Peptides 1989;10(4):797-803.

Grandt, D., et al., "Two molecular forms of peptide YY (PYY) are abundant in human blood: characterization . . . recognizing PYY 1-36 and PYY 3-36," Regul Pept 1994;51(2):151-159.

Knudsen, L., et al., "Potent derivatives of glucagon-like peptide-1 with pharmacokinetic properties suitable for once daily administration," J. of Med. Chem. 2000;43(9):1664-1669.

Ritzel, R., et al., "Pharmacokinetic, insulinotropic, and glucagonostatic properties of . . . in healthy volunteers. Dose-response-relationships," Diabetologia 1995;38(6):720-725.

Deacon, C., et al., "Degradation of glucagon-like peptide-1 by . . . N-terminally truncated peptide that is a major endogenous metabolite in vivo," J Clin Endocrinol Metab., 1995, 80(3):952-957.

Deacon, C., et al., "Both subcutaneously and intravenously . . . from the NH2-terminus in type II diabetic patients and in healthy subjects," Diabetes 1995;44(9):1126-1131.

Batterham, R., et al., "Gut hormone PYY(3-36) physiologically inhibits food intake," Nature 2002;418(6898):650-654.

Dickson, L., et al., "VPAC and PAC receptors: From ligands to function," Pharmacology & Therapeutics 2009;121(3):294-316.

Higuchi, T. and V. Stella (eds.), "Pro-Drugs as Novel Delivery Systems", Am. Chem. Soc., 1975.

Gozes, I., et. al. , "VIP and drug design," Current Pharmaceutical Design 2003;9(6):483-494.

Delgado, M., et. al., "Anti-inflammatory neuropeptides: A new class of endogenous immunoregulatory agents," Brain Behav Immun 2008;22(8):1146-1151.

Gonzalez-Rey, E., et. al., "Anti-inflammatory neuropeptide receptors: new therapeutic targets for immune disorders?" TRENDS Pharmacol Sci 2007;28(9):482-491.

Varela, N., et. al., "Tuning inflammation with anti-inflammatory neuropeptides," Expert Opin Biol Ther 2007;7(4):461-478.

Brenneman, D., "Neuroprotection: A comparative view of vasoactive intestinal peptide and pituitary adenylate cyclase-activating polypeptide," Peptides 2007;28(9):1720-1726.

Onoue, S., et. al., "Structure-activity relationship . . . (VIP): potent agonists and potential clinical applications," Naunyn Schmiedebergs Arch Pharmacal. Jun. 2008;377(4-6):579-590.

de Serres et al., Immunogenicity of thrombopoietin mimetic peptide GW395058 in BALC/c mice and New Zealand white rabbits: evaluation of the potential for thrombopoietin neutralizing antibody production in man, Stem Cells 1999 17(4):203-209.

Dewit et al., The vasoactive intestinal peptide analogue RO25-1553 inhibits the production of TNF and IL-12 by LPS-activated monocytes, Immunol Lett 1998 60(1):57-60.

O'Donnell et al., RO25-1553: A novel long-acting vasoactive intestinal peptide agonist. Part 1: In vitro and in vivo bronchodilator studies, J Pharmacol Exp Ther 1994 270(3):1282-1288.

* cited by examiner

PANEL A

PANEL B

PANEL A

PANEL B

HIGHLY ACTIVE POLYPEPTIDES AND METHODS OF MAKING AND USING THE SAME

CROSS-REFERENCE TO RELATED APPLICATIONS

This application claims priority to U.S. Provisional Ser. No. 61/364,098, filed on Apr. 22, 2010; U.S. Provisional Ser. No. 61/364,359, filed on Jul. 14, 2010; U.S. Provisional Ser. No. 61/405,560, filed on Oct. 21, 2010; and U.S. Provisional Ser. No. 61/445,468, filed on Feb. 22, 2011, all of which are herein incorporated by reference in their entirety.

FIELD OF THE INVENTION

The invention relates generally to compositions comprising modified polypeptide sequences with greater resistance to degradation and equivalent and/or increased bioactivity as compared to naturally encoded, unmodified polypeptide sequences, and to methods of making the compositions and methods of using the compositions as pharmaceutically active agents to treat disease in animals, including humans.

BACKGROUND OF THE INVENTION

The secretin family is a family of well-conserved animal proteins with a variety of biological functions. Biologically active members of the secretin family are generally from about 26 to about 65 amino acids in length and are thought to have relatively simple alpha-helical secondary structures. Many members are originally produced in vivo as larger pro-peptides, which are eventually converted in the active forms. Members of the secretin family include the following proteins: GHRF, GIP, GLP-1, Glucagon, PACAP-27, PACAP-38, PHM, PrP, and secretin. The q25 region of chromosome 6 on the human genome encodes another secretin family member that is 170 amino acids long which becomes post-translationally cleaved to form vasoactive intestinal peptide (VIP). The active form of the VIP polypeptide is a 28 amino acid protein that functions, among other ways, to reduce arterial blood pressure, to increase vasodilation of blood vessel walls, to relax smooth muscle in the respiratory system and gastrointestinal tissues, reduce inflammatory responses through both promotion of Th2 differentiation as well as the reduction of Th1 responses, modulate both the innate and adaptive immune response, and to stimulate secretion of electrolytes in the gut. VIP has also been shown to be active in the central nervous system as a neurotransmitter and in communication with lymphocytes. Bioactivity of VIP is transmuted through three known receptor subtypes: $VIP_1R$, $VIP_2R$, and $PAC_1R$. These receptors are known to induce cAMP concentration as well as stimulate the production of intracellular calcium. Their affinities for secretins such as VIP vary depending upon the subtype and the amino acid sequence of the ligand.

Secretin family members have short half-lives. For instance, VIP has a half-life of about two minutes in the blood stream. It is desirable to identify polypeptides that mimic the function of secretins such as VIP, but have increased half-life and equivalent or more bioactivity than the naturally occurring VIP amino acid sequence. It is also desirable to identify another peptidomimetic of VIP to have association to one receptor subtype over another secretin receptor.

HDL cholesterol level is inversely related to the incidence of coronary heart disease and recently received increasing attention as a novel target in lipid management of treating atherosclerotic vascular disease. Direct vascular protective effects of HDL have been attributed to apolipoprotein (apo) A-I or apoA-I-associated molecules in HDL using direct intravenous injections of homologous HDL,3 recombinant mutant apoA-Imilano or apoA-I gene therapy, or use of transgenic animals overexpressing apoA-I or apoAI-related molecules such as paraoxonase. A recent phase II randomized trial showed that 5 weekly intravenous injections of recombinant apoA-1milano induced rapid regression of coronary atherosclerotic lesions in humans. It is desirable to identify polypeptides that mimic the function of apoA-1 such as paraoxonase, but have increased half-life and equivalent or more bioactivity than the naturally occurring paraoxonase amino acid sequence. It is also desirable to identify another peptidomimetic of apoA-1 to have association to a natural ligand for apoA-1 as compared to wild-type sequences.

Cytokines mediate cellular activities in a number of ways. Cytokines support the proliferation, growth, and differentiation of pluripotential hematopoietic stem cells into vast numbers of progenitors comprising diverse cellular lineages making up a complex immune system. Proper and balanced interactions between the cellular components are necessary for a healthy immune response. The different cellular lineages often respond in a different manner when cytokines are administered in conjunction with other agents.

Cytokines mediate communication between cells of the immune system, e.g., antigen presenting cells (APCs) and T lymphocytes. Dendritic cells (DCs) are the most potent of antigen presenting cells. See, e.g., Paul (ed.) (1993) Fundamental Immunology 3d ed., Raven Press, NY. Antigen presentation refers to the cellular events in which a proteinaceous antigen is taken up, processed by antigen presenting cells (APC), and then recognized to initiate an immune response. The most active antigen presenting cells have been characterized as the macrophages (which are direct developmental products from monocytes), dendritic cells, and certain B cells. DCs are highly responsive to inflammatory stimuli such as bacterial lipopolysaccharides (LPS), and cytokines such as tumor necrosis factor alpha (TNFalpha). Cytokines or stimuli, such as LPS, can induce a series of phenotypic and functional changes in DC that are collectively referred to as maturation. See, e.g., Banchereau and Schmitt (eds.) (1995) Dendritic Cells in Fundamental and Clinical Immunoloy, Plenum Press, NY. It is desirable to identify polypeptides that mimic the function of cytokine families such as IL-10, IL-2, IL-4, IL-12, and IL-17, but have increased half-life and equivalent or more bioactivity than the naturally occurring IL-10, IL-2, IL-4, IL-12, and IL-17 representative amino acid sequences. It is also desirable to identify another peptidomimetic of a cytokine such as IL-17 to have association to a natural receptor for IL-17 as compared to wild-type sequences.

Chemists have long sought to extrapolate the power of biological catalysis and recognition to synthetic systems. These efforts have focused largely on low-molecular weight catalysts and receptors. Most biological systems, however, rely almost exclusively on large polymers such as proteins and RNA to perform complex biochemical and/or biological functions. There is a long-felt need to identify synthetic polymers of amino acids which display discrete and predictable folding propensities to mimic natural biological systems. Such polypeptides are designed to provide a molecular equivalent or improved functionality as compared to naturally occurring protein-protein interactions specifically because of their ability to mimic natural interactions in addition to their resistance to natural degradative enzymes in a subject. Whereas a naturally occurring probe, comprised entirely of α-amino acid residues, will be readily degraded by any number of proteases and peptidases, the secretin analogs of the present invention comprising a mixture of α- and β-amino acid residues are not degraded in the same manner.

There is a need for secretin analogs that exhibit increased conformational constraints or increased conformational flexibility and greater half-lives. Increased conformational constraints may lock the active domain of the polypeptides into their active state. Increased conformational flexibility of the polpeptide may yield a high affinity selectivity for the naturally occurring polypeptide's natural biological target. There is a need for use of such analogs, compositions comprising such analogs, and methods of using the compositions as pharmaceutically active agents to treat disease in animals. New polypeptide analogs are disclosed that may provide one or more increased half-life, reduced degradation upon administration, reduced degradation upon solubilization, increased conformational constraints and that produce the same or greater biological effect as compared to naturally occurring secretin family members. The present invention addresses these and other needs associated with treatment and prevention of disease that implicate dysfunction of biological systems involving naturally occurring polypeptides.

SUMMARY OF THE INVENTION

In some embodiments, the invention relates to compositions comprising a helical polypeptide synthesized with a repeated pattern of β-amino acids at positions along the entire length of a polypeptide chain. For any of the peptides described herein, there may embodiments in which there are no β-amino acids within the peptide. The selected pattern of synthetic amino acids along the helical polypeptide decreases the rate at which the polypeptide may degrade when administered to a subject or when reconstituted or placed in solution. Selected side chains of the amino acids increase the conformational rigidity of the polypeptide in order to constrain the polypeptide in its active state. The selected pattern of synthetic amino acids along the helical polypeptide increases the half-life of the polypeptide as compared to naturally encoded polypeptides with the same α-amino acid sequence. In some embodiments, the polypeptide comprises β-amino acids that spatially aligned along a longitudinal axis of the analog in order to confer degradation resistance to the composition while preserving the native binding interface. In some embodiments, the composition comprises a secretin analog. In some embodiments, the composition comprises a vasoactive intestinal peptide (VIP) analog, wherein said analog comprises an α-amino acid and at least one β-amino acid.

In some embodiments, the composition comprises a secretin analog wherein the total number of β-amino acids in the analog is from about 10 percent to about 60 percent of the total number of amino acids of the analog. In some embodiments, the composition comprises a secretin analog wherein the total number of β-amino acids in the analog is from about 12 percent to about 50 percent of the total number of amino acids of the analog. In some embodiments, the composition comprises a secretin analog wherein the total number of β-amino acids in the analog is from about 14 percent to about 50 percent of the total number of amino acids of the analog. In some embodiments, the composition comprises a secretin analog wherein the total number of β-amino acids in the analog is from about 16 percent to about 50 percent of the total number of amino acids of the analog. In some embodiments, the composition comprises a secretin analog wherein the total number of β-amino acids in the analog is from about 18 percent to about 50 percent of the total number of amino acids of the analog. In some embodiments, the composition comprises a secretin analog wherein the total number of β-amino acids in the analog is from about 20 percent to about 50 percent of the total number of amino acids of the analog. In some embodiments, the composition comprises a secretin analog wherein the total number of β-amino acids in the analog is from about 30 percent to about 50 percent of the total number of amino acids of the analog.

In some embodiments, the composition comprises a secretin analog wherein the total number of β-amino acids in the analog is from about 40 percent to about 50 percent of the total number of amino acids of the analog. In some embodiments, the composition comprises a secretin analog wherein the total number of β-amino acids in the analog is from about 45 percent to about 50 percent of the total number of amino acids of the analog. In some embodiments, the composition comprises a secretin analog wherein the total number of β-amino acids in the analog is from about 40 percent to about 45 percent of the total number of amino acids of the analog.

In some embodiments, the composition comprises a secretin analog wherein the total number of β-amino acids in the analog is from about 30 percent to about 40 percent of the total number of amino acids of the analog. In some embodiments, the composition comprises a secretin analog wherein the total number of β-amino acids in the analog is from about 35 percent to about 40 percent of the total number of amino acids of the analog. In some embodiments, the composition comprises a secretin analog wherein the total number of β-amino acids in the analog is from about 20 percent to about 30 percent of the total number of amino acids of the analog.

In some embodiments, the composition comprises a secretin analog wherein the total number of β-amino acids in the analog is from about 10 percent to about 20 percent of the total number of amino acids of the analog. In some embodiments, the composition comprises a secretin analog wherein the total number of β-amino acids in the analog is from about 15 percent to about 20 percent of the total number of amino acids of the analog. In some embodiments, the composition comprises a secretin analog wherein the total number of β-amino acids in the analog is from about 20 percent to about 25 percent of the total number of amino acids of the analog. In some embodiments, the composition comprises a secretin analog wherein the total number of β-amino acids in the analog is from about 25 percent to about 30 percent of the total number of amino acids of the analog. In some embodiments, the composition comprises a secretin analog wherein the total number of β-amino acids in the analog is from about 30 percent to about 35 percent of the total number of amino acids of the analog.

In some embodiments, the invention relates to analogs of various protein targets. In some embodiments, the amino acid sequences upon which the analogs are based or derived include biologically active polypeptides chosen from the group of transcription factors, ligands for cellular receptors, hormones and extracellular binding peptides. In some embodiments, the invention comprises analogs of derived from amino acid sequences chosen from human and non-human enkephlin, LHRH, neuropeptides, glycoincretins, integrin, glucagons and glucagon-like peptides, antithrombotic peptides, cytokines and interleukins, transferrins, interferons, endothelins, natriuretic hormones, extracellular kinase ligands, angiotensin enzyme inhibitors, peptide antiviral compounds, thrombin, substance P, substance G, somatotropin, somatostatin, GnRH, bradykinin, vasopressin, insulin, and growth factors. The amino acid sequences of these proteins or peptides are known to the skilled artisan and can be obtained by numerous means. The amino acid sequences are incorporated herein by reference from databases such as, for example, GenBank.

As used herein, "glucagon-like peptide-1" or "GLP-1" shall include those polypeptides and proteins that have at least one biological activity of human GLP-1, including but not limited to those described in U.S. Patent Publication No. 20040127412, EP 0699686-A2 and EP0733,644, U.S. Pat. Nos. 5,545,618; 5,118,666; 5,512,549; WO 91/11457; WO 90/11296; WO 87/06941 which are incorporated by reference herein, as well as GLP-1 analogs, GLP-1 isoforms, GLP-1 mimetics, GLP-1 fragments, hybrid GLP-1 proteins, fusion proteins, oligomers and multimers, homologues, glycosylation pattern variants, and muteins, thereof, regardless of the biological activity of same, and further regardless of the method of synthesis or manufacture thereof including synthetic, transgenic, and gene activated methods. Numerous GLP-1 analogs and derivatives are known and are referred to herein as "GLP-1 compounds." These GLP-1 analogs include the Exendins which are peptides found in the venom of the GILA-monster. Specific examples of GLP-1 include, but are not limited to, GLP-1(3-36), GLP-1(3-37), GLP-1(1-45), and Exendins 1 through 4. Further, it is possible to obtain GLP-1 through the use of recombinant DNA technology, as disclosed by Maniatis, T., et al., Molecular Biology: A Laboratory Manual, Cold Spring Harbor, N.Y. (1982), and produce GLP-1 in host cells by methods known to one of ordinary skill in the art.

The term "human GLP-1 (GLP-1)" or "GLP-1 polypeptide" refers to GLP-1 as described herein, as well as a polypeptide that retains at least one biological activity of a naturally-occurring GLP-1. GLP-1 polypeptides also include the pharmaceutically acceptable salts and prodrugs, and prodrugs of the salts, polymorphs, hydrates, solvates, biologically-active fragments, biologically active variants and stereoisomers of the naturally-occurring human GLP-1 as well as agonist, mimetic, and antagonist variants of the naturally-occurring human GLP-1, the family of exendins including exendins 1 through 4, and polypeptide fusions thereof. Examples of GLP-1 polypeptides include, but are not limited to, those described in U.S. Pat. No. 5,118,666; which is incorporated by reference herein. Fusions comprising additional amino acids at the amino terminus, carboxyl terminus, or both, are encompassed by the term "GLP-1 polypeptide." Exemplary fusions include, but are not limited to, e.g., fusions for the purpose of purification (including, but not limited to, to poly-histidine or affinity epitopes), fusions with serum albumin binding peptides; fusions with serum proteins such as serum albumin; fusions with constant regions of immunoglobulin molecules such as Fc; and fusions with fatty acids. The naturally-occurring GLP-1 nucleic acid and amino acid sequences for various forms are known, as are variants such as single amino acid variants or splice variants.

The term "GLP-1 polypeptide" encompasses GLP-1 polypeptides comprising one or more amino acid substitutions, additions or deletions. Exemplary substitutions in a wide variety of amino acid positions in naturally-occurring GLP-1 have been described, including but not limited to, substitutions that modulate one or more of the biological activities of GLP-1, such as but not limited to, increase agonist activity, increase solubility of the polypeptide, convert the polypeptide into an antagonist, decrease peptidase or protease susceptibility, etc. and are encompassed by the term "GLP-1 polypeptide."

Human GLP-1 antagonists include, but are not limited to, those with a substitutions at: 7, 8, 9, 22, 18, 29, 25, 32, 21, 28, 17, 24, 31, and 20 (other GLP-1 sequence of U.S. Patent Application Publication 2010-0048871). In some embodiments, the GLP-1 antagonist comprises a non-naturally encoded amino acid linked to a water soluble polymer that is present in a receptor binding region of the GLP-1 molecule. In some embodiments the water soluble polymer is coupled to the GLP-1 polypeptide at one or more of the amino acid positions: 7, 8, 9, 22, 18, 29, 25, 32, 21, 28, 17, 24, 31, and 20 (U.S. Patent Application Publication 2010-0048871).

For the GLP-1 amino acid sequence as well as the exendin-4 and exendin-3 amino acid sequence, {His Ala Glu Gly Thr Phe Thr Ser Asp Val Ser Ser Tyr Leu Glu Gly Gln Ala Ala Lys Glu Phe Ile Ala Trp Leu Val Lys Gly Arg} (GLP-1(7-36), SEQ ID NO: 1330); {His Ala Glu Gly Thr Phe Thr Ser Asp Val Ser Ser Tyr Leu Glu Gly Gln Ala Ala Lys Glu Phe Ile Ala Trp Leu Val Lys Gly Arg Gly} (GLP-1(7-37), SEQ ID NO:1331); {His Gly Glu Gly Thr Phe Thr Ser Asp Leu Ser Lys Gln Met Glu Glu Glu Ala Val Arg Leu Phe Ile Glu Trp Leu Lys Asn Gly Gly Pro Ser Ser Gly Ala Pro Pro Pro Ser} (exendin-4, SEQ ID NO:1332); and {His Ser Asp Gly Thr Phe Thr Ser Asp Leu Ser Lys Gln Met Glu Glu Glu Ala Val Arg Leu Phe Ile Glu Trp Leu Lys Asn Gly Gly Pro Ser Ser Gly Ala Pro Pro Pro Ser} (exendin-3, SEQ ID NO:724). In some embodiments, GLP-1 polypeptides of the invention are substantially identical to the sequences above, or any other sequence of a GLP-1 polypeptide (see, U.S. Patent Application Publication 2010-0048871). Nucleic acid molecules encoding GLP-1 mutants and mutant GLP-1 polypeptides are well known. Examples of GLP-1 mutants include those disclosed in U.S. Patent Publication No. 20040127412A1; which is incorporated by reference herein.

A number of GLP-1 products are in preclinical and clinical development, including GLP-1 peptide analogs, conjugates, fusion proteins, and drug delivery or combination therapies. Some of the products in development are Exenatide (AC2993, Amylin/Eli Lilly), AVE-0010 (ZP10, Zealand Pharm/Aventis), BIM-51077 (Ipsen/Roche), Liraglutide (NN2211, Novo Nordisk), CJC-1131 (Conjuchem), Albugon (Human Genome Sciences/Glaxo Smith Kline), GLP-1 transferrin (Biorexis), AC2993 LAR (Amylin/Alkermes), GLP-1 nasal (Suntory) and GLP-1-INT (Transition Therapeutics).

The biological activities of GLP-1 have been disclosed and are known in the art, and can be found, for example, in U.S. Patent Publication No: 20040082507A1 and 20040232754A1 which are incorporated by reference herein.

Variants of GLP-1(7-37) and analogs thereof, also have been disclosed. These variants and analogs include, for example, Gln$^9$-GLP-1(7-37), D-Gln$^9$-GLP-1(7-37), acetyl-Lys$^9$-GLP-1(7-37), Thr$^{16}$-Lys$^{18}$-GLP-1(7-37), Lys$^{18}$-GLP-1(7-37) and the like, and derivatives thereof including, for example, acid addition salts, carboxylate salts, lower alkyl esters, and amides (see, e.g., WO 91/11457; EP0733,644 (1996); and U.S. Pat. No. 5,512,549 (1996), which are incorporated by reference). Generally, the various disclosed forms of GLP-1 are known to stimulate insulin secretion (insulinotropic action) and cAMP formation (see, e.g., Mojsov, S., Int. J. Peptide Protein Research, 40:333-343 (1992)).

As used herein, "T-20" or "DP-178" shall include those polypeptides and proteins that have at least one biological activity of human DP-178, as well as DP-178 analogs, DP-178 isoforms, DP-178 mimetics, DP-178 fragments, hybrid DP-178 proteins, fusion proteins, oligomers and multimers, homologues, glycosylation pattern variants, and muteins, thereof, regardless of the biological activity of same, and further regardless of the method of synthesis or manufacture thereof including, but not limited to, recombinant (whether produced from cDNA, genomic DNA, synthetic DNA or other form of nucleic acid), synthetic, transgenic, and gene activated methods. Hyphenated and non-hyphenated forms (T20, DP178) of the terms are equivalent.

The term "human DP-178" or "DP-178 polypeptide" refers to DP-178 or T-20 as described herein, as well as a polypeptide that retains at least one biological activity of a naturally-occurring DP-178. "DP-178" includes portions, analogs, and homologs of DP-178, all of which exhibit antiviral activity. Antiviral activity includes, but is not limited to, the inhibition of HIV transmission to uninfected CD-4+ cells. Further, the invention relates to the use of DP-178 and DP-178 fragments and/or analogs or homologs as inhibitors of retroviral transmission, in particular HIV, to uninfected cells, in both humans and non-humans. Non retroviral viruses whose transmission may be inhibited by the peptides of the invention include, but are not limited to enveloped viruses, human respiratory syncytial virus, canine distemper virus, Newcastle disease virus, human parainfluenza virus, and influenza viruses.

DP-178 polypeptides also include the pharmaceutically acceptable salts and prodrugs, and prodrugs of the salts, polymorphs, hydrates, solvates, biologically-active fragments, biologically active variants and stereoisomers of the naturally-occurring human DP-178 as well as agonist, mimetic, and antagonist variants of the naturally-occurring human DP-178, and polypeptide fusions thereof. Fusions comprising additional amino acids at the amino terminus, carboxyl terminus, or both, are encompassed by the term "DP-178 polypeptide." Exemplary fusions include, but are not limited to, e.g., methionyl DP-178 in which a methionine is linked to the N-terminus of DP-178 resulting from the recombinant expression of DP-178, fusions for the purpose of purification (including, but not limited to, to poly-histidine or affinity epitopes), T-20 extended at the N-terminus, fusions with serum albumin binding peptides; fusions with serum proteins such as serum albumin; fusions with constant regions of immunoglobulin molecules such as Fc; and fusions with fatty acids. The naturally-occurring DP-178 nucleic acid and amino acid sequences are known, as are variants such as single amino acid variants or splice variants.

The term "DP-178 polypeptide" encompasses DP-178 polypeptides comprising one or more amino acid substitutions, additions or deletions. Exemplary substitutions in a wide variety of amino acid positions in naturally-occurring DP-178 have been described, including but not limited to, substitutions that modulate one or more of the biological activities of DP-178, such as but not limited to, increase agonist activity, increase solubility of the polypeptide, convert the polypeptide into an antagonist, decrease peptidase or protease susceptibility, etc. and are encompassed by the term "DP-178 polypeptide," the DP-178 amino acid sequence, (Tyr Thr Ser Leu He His Ser Leu lle Glu Glu Ser Gln Asn Gln Gln Glu Lys Asn Glu Gln Glu Leu Leu Glu Leu Asp Lys Trp Ala Ser Leu Trp Asn Trp Phe) (SEQ ID NO:1333). In some embodiments, DP-178 polypeptides of the invention are substantially identical to the following sequences or functional fragments thereof: (Tyr Thr Ser Leu He His Ser Leu Ile Glu Glu Ser Gln Asn Gln Gln Glu Lys Asn Glu Gln Glu Leu Leu Glu Leu Asp Lys Trp Ala Ser Leu Trp Asn Trp Phe); Glu Trp Asp Arg Glu Ile Asn Asn Tyr Thr Ser Leu Ile His Ser Leu Ile Glu Glu Ser Gln Asn Gln Gln Glu Lys Asn Glu Gln Glu Leu Leu Glu Leu Asp Lys Trp Ala Ser Leu Trp Asn Trp Phe (SEQ ID NO:1334); or any other sequence of a DP-178 polypeptide. Nucleic acid molecules encoding DP-178 mutants and mutant DP-178 polypeptides are well known.

A commercially available form of DP-178 is Fuzeon®. (enfuvirtide. Roche Laboratories Inc. and Trimeris, Inc.). Fuzeon® has an acetylated N terminus and a carboxamide as the C-terminus. It is used in combination with other antivirals in HIV-1 patients that show HIV-1 replication despite ongoing antiretroviral therapy.

As used herein, "PYY" and "peptide YY" shall include those polypeptides and proteins that have at least one biological activity of human PYY, as well as PYY analogs, PYY isoforms, PYY mimetics, PYY fragments, hybrid PYY proteins, fusion proteins, oligomers and multimers, homologues, glycosylation pattern variants, and muteins, thereof, regardless of the biological activity of same, and further regardless of the method of synthesis or manufacture thereof including, but not limited to, recombinant (whether produced from cDNA, genomic DNA, synthetic DNA or other form of nucleic acid), synthetic, transgenic, and gene activated methods.

The term "PYY" or "PYY polypeptide" refers to PYY as described herein, as well as a polypeptide that retains at least one biological activity of a naturally-occurring PYY. "PYY" includes portions, analogs, and homologs of PYY including, but not limited to, PYY(3-36), full-length PYY, PYY(22-36), and DPPIV resistant variants of PYY. The term "PYY" includes the human full length: Tyr Pro Ile Lys Pro Glu Ala Pro Gly Glu ASp Ala Ser Pro Glu Glu Leu Asn Arg Tyr Tyr Ala Ser Leu Arg His Tyr Leu Asn Leu Val Thr Arg Gln Arg Tyr (SEQ ID NO: 561), which is disclosed in International Publication No. WO 02/47712 (which is the PCT counterpart to U.S. patent Publication No. 2002/0141985, which is hereby incorporated by reference) and the following amino acid sequences from Tatemoto, *Proc Natl Acad Sci U.S.A.* 79:2514-8, 1982, which are incorporated by reference herein:

```
                                            (SEQ ID NO: 1375)
  1. Tyr-Pro-Ala-Lys-Pro-Glu-Ala-Pro-Gly (SEQ ID NO: 1376)
  2. Tyr-Pro-Ala-Lys-Pro-Glu-Ala-Pro-Gly-Glu-Asp-

Ala-Ser-Pro-Glu-Glu-Leu-Ser-Arg (SEQ ID NO: 1377)
  3. Tyr-Tyr-Ala-Ser-Leu-Arg (SEQ ID NO: 1378)
  4. His-Tyr-Leu-Asn-Leu-Val-Thr-Arg (SEQ ID NO: 6)

(SEQ ID NO: 1379)
  5. Tyr-Pro-Ala-Lys-Pro-Glu-Ala-Pro-Gly-Glu-Asp-

Ala-Ser-Pro-Glu-Glu-Leu-Ser-Arg-Tyr-Tyr-Ala-

Ser-Leu-Arg-His-Tyr-Leu-Asn-Leu-Val-Thr-Arg-

Gln-Arg-Tyr-NH$_2$
```

PYY agonists are also included in the term "PYY". PYY agonists include any compound which elicits an effect of PYY to reduce nutrient availability, for example a compound (1) having activity in the food intake, gastric emptying, pancreatic secretion, or weight loss assays described in Examples 1, 2, 5, or 6 of WO 02/47712 and U.S. patent Publication No. 2002/0141985, and (2) which binds specifically in a Y receptor assay (Example 10 of WO 02/47712 and U.S. patent Publication No. 2002/0141985) or in a competitive binding assay with labeled PYY or PYY {3-36} from certain tissues having an abundance of Y receptors, including e.g., area postrema (Example 9 of WO 02/47712 and U.S. patent Publication No. 2002/0141985), wherein the PYY agonist is not pancreatic polypeptide. In some embodiments, PYY agonists would bind in such assays with an affinity of greater than about 1 µM, or with an affinity of greater than about 1 nM to about 5 nM.

Such agonists can comprise a polypeptide having a functional PYY domain, an active fragment of PYY, or a chemical or small molecule. PYY agonists may be peptide or peptide-nonpeptide hybrid molecules, and include "PYY agonist analogs," which refer to any compound structurally similar to a PYY that have PYY activity typically by virtue of binding to or otherwise directly or indirectly interacting with a PYY receptor or other receptor or receptors with which PYY itself may interact to elicit a biological response. Such compounds include derivatives of PYY, fragments of PYY, extended PYY molecules having more than 36 amino acids, truncated PYY molecules having less than 36 amino acids, and substituted PYY molecules having one or more different amino acids as compared to the wild-type or consensus sequence, or any combination of the above. Such compounds may also be modified by processes such as pegylation, amidation, glycosylation, acylation, sulfation, phosphorylation, acetylation and cyclization.

One such PYY agonist analog is PYY (3-36), identified as Ile Lys Pro Glu Ala Pro Gly Glu Asp Ala Ser Pro Glu Glu Leu Asn Arg Tyr Tyr Ala Ser Leu Arg His Tyr Leu Asn Leu Ile Lys pro Glu Ala Pro Gly Glu ASp Ala Ser Pro Glu Glu Leu Asn Arg Tyr Tyr Ala Ser Leu Arg His Tyr Leu Asn Leu Val Thr Arg Gln Arg Tyr Val Thr Arg Gln Arg Tyr (SEQ ID NO:559); Eberlein, Eysselein et al., Peptides 10:797-803 (1989); and Grandy, Schimiczek et al., Regul Pept 51:151-9 (1994). Additional PYY fragments and derivatives are described in U.S. Patent Publication 20050002927 whose sequences follow: All of the above referenced patent publications are incorporated by reference herein.

PYY polypeptides also include the pharmaceutically acceptable salts and prodrugs, and prodrugs of the salts, polymorphs, hydrates, solvates, biologically-active fragments, biologically active variants and stereoisomers of the naturally-occurring human PYY as well as agonist, mimetic, and antagonist variants of the naturally-occurring human PYY, and polypeptide fusions thereof. Fusions comprising additional amino acids at the amino terminus, carboxyl terminus, or both, are encompassed by the term "PYY polypeptide." Exemplary fusions include, but are not limited to, e.g., fusions with serum albumin binding peptides; fusions with serum proteins such as serum albumin; fusions with constant regions of immunoglobulin molecules such as Fc; and fusions with fatty acids. The naturally-occurring PYY nucleic acid and amino acid sequences are known, as are variants such as single amino acid variants or splice variants.

The term "PYY polypeptide" encompasses PYY polypeptides comprising one or more amino acid substitutions, additions or deletions. Exemplary substitutions in a wide variety of amino acid positions in naturally-occurring PYY have been described, including but not limited to, substitutions that modulate one or more of the biological activities of PYY, such as but not limited to, increase agonist activity, increase solubility of the polypeptide, convert the polypeptide into an antagonist, decrease peptidase or protease susceptibility, etc. and are encompassed by the term "PYY polypeptide."

In some embodiments, PYY polypeptides of the invention are substantially identical to Ile Lys Pro Glu Ala Pro Gly Glu Asp Ala Ser Pro Glu Glu Leu Asn Arg Tyr Tyr Ala Ser Leu Arg His Tyr Leu Asn Leu Val Thr Arg Gln Arg Tyr (SEQ ID NO: 559) or any other sequence of a PYY polypeptide (see, U.S. Patent Application Publication 2010-0048871). Nucleic acid molecules encoding PYY mutants and mutant PYY polypeptides are well known.

Various references disclose modification of polypeptides by polymer conjugation or glycosylation. The term analog includes polypeptides conjugated to a polymer such as PEG and may be comprised of one or more additional derivitizations of cysteine, lysine, or other residues. In addition, analogs of the instant invention may comprise a linker or polymer, wherein the amino acid to which the linker or polymer is conjugated may be a non-natural amino acid, or may be conjugated to a naturally encoded amino acid utilizing techniques known in the art such as coupling to lysine or cysteine.

Polymer modification of polypeptides has been reported. U.S. Pat. No. 4,904,584 discloses PEGylated lysine depleted polypeptides, wherein at least one lysine residue has been deleted or replaced with any other amino acid residue. WO 99/67291 discloses a process for conjugating a protein with PEG, wherein at least one amino acid residue on the protein is deleted and the protein is contacted with PEG under conditions sufficient to achieve conjugation to the protein. WO 99/03887 discloses PEGylated variants of polypeptides belonging to the growth hormone superfamily, wherein a cysteine residue has been substituted with a non-essential amino acid residue located in a specified region of the polypeptide. WO 00/26354 discloses a method of producing a glycosylated polypeptide variant with reduced allergenicity, which as compared to a corresponding parent polypeptide comprises at least one additional glycosylation site. U.S. Pat. No. 5,218,092 discloses modification of granulocyte colony stimulating factor (G-CSF) and other polypeptides so as to introduce at least one additional carbohydrate chain as compared to the native polypeptide. Examples of PEGylated peptides include GW395058, a PEGylated peptide thrombopoietin receptor (TPOr) agonist (de Serres M., et al., Stem Cells. 1999; 17(4):203-9), and a PEGylated analogue of growth hormone releasing factor (PEG-GRP; D'Antonio M, et al. Growth Horm IGF Res. 2004 June; 14(3):226-34).

The term analog also includes glycosylated analogs, such as but not limited to, analogs glycosylated at any amino acid position, N-linked or O-linked glycosylated forms of the polypeptide. In addition, splice variants are also included. The term analog also includes heterodimers, homodimers, heteromultimers, or homomultimers of any one or more polypeptide, protein, carbohydrate, polymer, small molecule, linker, ligand, or other biologically active molecule of any type, linked by chemical means or expressed as a fusion protein, as well as polypeptide analogs containing, for example, specific deletions or other modifications yet maintain biological activity.

Various references disclose additional variants of GLP-1 and acylation of GLP-1, including, but not limited to, the GLP-1 parent analogs and acylation sites described in J. of Med. Chem. (2000) 43:1664-1669, which is incorporated herein by reference.

Those of skill in the art will appreciate that aminoacid positions corresponding to positions in analogs can be readily identified in any other molecule such as analog fusions, variants, fragments, etc. For example, sequence alignment by visual means or computer programs such as BLAST can be used to align and identify a particular position in a protein that corresponds with a position in the analog of polypeptide sequences identified in this application or other GLP-1, VIP, PYY, IL-10, PACAP, Ghrelin, ANP/BNP/CNP, Maxadilan/M65, Apolipoprotein mimetic polypeptides and any other analog sequences are intended to also refer to substitutions, deletions or additions in corresponding positions in GLP-1, VIP, PYY, IL-10, PACAP, Ghrelin, ANP/BNP/CNP, Maxadilan/M65, Apolipoprotein mimetic polypeptides fusions, variants, fragments, etc. described herein or known in the art and are expressly encompassed by the present invention.

The term analog encompasses polypeptides comprising one or more amino acid substitutions, additions or deletions. Analogs of the present invention may be comprised of modifications with one or more natural amino acids in conjunction with one or more non-natural amino acid modification. Exemplary substitutions in a wide variety of amino acid positions in naturally-occurring analogs have been described, including but not limited to substitutions that modulate one or more of the biological activities of the analogs, such as but not limited to, increase agonist activity, increase solubility of the polypeptide, convert the polypeptide into an antagonist, decrease peptidase or protease susceptibility, etc. and are encompassed by the term analog.

Human GLP-1 antagonists include, but are not limited to, those with a substitutions at: 19, 23, 26, 27, 28, 29, 30, and 33 of the consensus sequence identified in Table 4. In some embodiments, the GLP-1 antagonist comprises a non-naturally encoded amino acid linked to a water soluble polymer that is present in a receptor binding region of the GLP-1 molecule. In some embodiments, the water soluble polymer is coupled to the GLP-1 polypeptide at one or more of the amino acid positions: 19, 23, 26, 27, 30, and 33 of the consensus sequence identified in Table 4.

In some embodiments, the analogs further comprise an addition, substitution or deletion that modulates biological activity of the analogs. For example, the additions, substitution or deletions may modulate one or more properties or activities of the analog. For example, the additions, substitutions or deletions may modulate affinity for the analog receptor or binding partner, modulate (including but not limited to, increases or decreases) receptor dimerization, stabilize receptor dimers, modulate the conformation or one or more biological activities of a binding partner, modulate circulating half-life, modulate therapeutic half-life, modulate stability of the polypeptide, modulate cleavage by peptidases or proteases, modulate dose, modulate release or bio-availability, facilitate purification, or improve or alter a particular route of administration. Similarly, analogs of the present invention may comprise protease cleavage sequences, reactive groups, antibody-binding domains (including but not limited to, FLAG or poly-His) or other affinity based sequences (including but not limited to, FLAG, poly-His, GST, etc.) or linked molecules (including but not limited to, biotin) that improve detection (including but not limited to, GFP), purification or other traits of the polypeptide.

A "non-naturally encoded amino acid" refers to an amino acid that is not one of the 20 common amino acids or pyrolysine or seienocysteine. Other terms that may be used synonymously with the term "non-naturally encoded amino acid" are "non-natural amino acid," "unnatural amino acid," "non-naturally-occurring amino acid," and variously hyphenated and non-hyphenated versions thereof. The term "non-naturally encoded amino acid" also includes, but is not limited to, amino acids that occur by modification (e.g. post-translational modifications) of a naturally encoded amino acid (including but not limited to, the 20 common amino acids or pyrolysine and selenocysteine) but are not themselves naturally incorporated into a growing polypeptide chain by the translation complex. Examples of such non-naturally-occurring amino acids include, but are not limited to, N-acetylglucosaminyl-L-serine, N-acetylglucosaminyl-L-threonine, and O-phosphotyrosine.

An "amino terminus modification group" refers to any molecule that can be attached to the amino terminus of a polypeptide. Similarly, a "carboxy terminus modification group" refers to any molecule that can be attached to the carboxy terminus of a polypeptide. Terminus modification groups include, but are not limited to, various water soluble polymers, peptides or proteins such as serum albumin, immunoglobulin constant region portions such as Fc, or other moieties that increase serum half-life of peptides.

The terms "functional group", "active moiety", "activating group", "leaving group", "reactive site", "chemically reactive group" and "chemically reactive moiety" are used in the art and herein to refer to distinct, definable portions or units of a molecule. The terms are somewhat synonymous in the chemical arts and are used herein to indicate the portions of molecules that perform some function or activity and are reactive with other molecules.

The term "linkage" or "linker" is used herein to refer to groups or bonds that normally are formed as the result of a chemical reaction and typically are covalent linkages. Hydrolytically stable linkages means that the linkages are substantially stable in water and do not react with water at useful pH values, including but not limited to, under physiological conditions for an extended period of time, perhaps even indefinitely. Hydrolytically unstable or degradable linkages mean that the linkages are degradable in water or in aqueous solutions, including for example, blood. Enzymatically unstable or degradable linkages mean that the linkage can be degraded by one or more enzymes. As understood in the art, PEG and related polymers may include degradable linkages in the polymer backbone or in the linker group between the polymer backbone and one or more of the terminal functional groups of the polymer molecule. For example, ester linkages formed by the reaction of PEG carboxylic acids or activated PEG carboxylic acids with alcohol groups on a biologically active agent generally hydrolyze under physiological conditions to release the agent. Other hydrolytically degradable linkages include, but are not limited to, carbonate linkages; imine linkages resulted from reaction of an amine and an aldehyde; phosphate ester linkages formed by reacting an alcohol with a phosphate group; hydrazone linkages which are reaction product of a hydrazide and an aldehyde; acetal linkages that are the reaction product of an aldehyde and an alcohol; orthoester linkages that are the reaction product of a formate and an alcohol; peptide linkages formed by an amine group, including but not limited to, at an end of a polymer such as PEG, and a carboxyl group of a peptide; and oligonucleotide linkages formed by a phosphoramidite group, including but not limited to, at the end of a polymer, and a 5' hydroxyl group of an oligonucleotide.

The term "biologically active molecule", "biologically active moiety" or "biologically active agent" when used herein means any substance which can affect any physical or biochemical properties of a biological system, pathway, molecule, or interaction relating to an organism, including but not limited to, viruses, bacteria, bacteriophage, transposon, prion, insects, fungi, plants, animals, and humans. In particular, as used herein, biologically active molecules include, but are not limited to, any substance intended for diagnosis, cure, mitigation, treatment, or prevention of disease in humans or other animals, or to otherwise enhance physical or mental well-being of humans or animals. Examples of biologically active molecules include, but are not limited to, peptides, proteins, enzymes, small molecule drugs, hard drugs, soft drugs, carbohydrates, inorganic atoms or molecules, dyes, lipids, nucleosides, radionuclides, oligonucleotides, toxins, cells, viruses, liposomes, microparticles and micelles. Classes of biologically active agents that are suitable for use with the invention include, but are not limited to, drugs, prodrugs, radionuclides, imaging agents, polymers, antibiotics, fungicides, anti-viral agents, anti-inflammatory agents, anti-tumor agents, cardiovascular agents, anti-anxiety agents, hormones, growth factors, steroidal agents, microbially derived toxins, and the like.

A "bifunctional polymer" refers to a polymer comprising two discrete functional groups that are capable of reacting specifically with other moieties (including but not limited to, amino acid side groups) to form covalent or non-covalent linkages. A bifunctional linker having one functional group reactive with a group on a particular biologically active component, and another group reactive with a group on a second biological component, may be used to form a conjugate that includes the first biologically active component, the bifunctional linker and the second biologically active component. Many procedures and linker molecules for attachment of various compounds to peptides are known. See, e.g., European Patent Application No 188, 256; U.S. Pat. Nos. 4,671,958, 4,659,839, 4,414,148, 4,699,784; 4,680,338; 4,569,789; and 4,589,071 which are incorporated by reference herein. A "multi-functional polymer" refers to a polymer comprising two or more discrete functional groups that are capable of reacting specifically with other moieties (including but not limited to, amino acid side groups) to form covalent or non-covalent linkages. A bifunctional polymer or multi-functional polymer may be any desired molecular length or molecular weight, and may be selected to provide a particular desired spacing or conformation between one or more molecules linked to the analog and its binding partner or the analog.

Representative non-limiting classes of polypeptides useful in the present invention include those falling into the following therapeutic categories: adrenocorticotropic hormone peptides, adrenomedullin peptides, allatostatin peptides, amylin peptides, amyloid beta-protein fragment peptides, angiotensin peptides, antibiotic peptides, antigenic polypeptides, anti-microbial peptides, apoptosis related peptides, atrial natriuretic peptides, bag cell peptides, bombesin peptides, bone GLA peptides, bradykinin peptides, brain natriuretic peptides, C-peptides, C-type natriuretic peptides, calcitonin peptides, calcitonin gene related peptides, CART peptides, casomorphin peptides, chemotactic peptides, cholecystokinin peptides, colony-stimulating factor peptides, corticortropin releasing factor peptides, cortistatin peptides, cytokine peptides, dermorphin peptides, dynorphin peptides, endorphin peptides, endothelin peptides, ETa receptor antagonist peptides, ETh receptor antagonist peptides, enkephalin peptides, fibronectin peptides, galanin peptides, gastrin peptides, glucagon peptides, Gn-RH associated peptides, growth factor peptides, growth hormone peptides, GTP-binding protein fragment peptides, guanylin peptides, inhibin peptides, insulin peptides, interleukin peptides, laminin peptides, leptin peptides, leucokinin peptides, luteinizing hormone-releasing hormone peptides, mastoparan peptides, mast cell degranulating peptides, melanocyte stimulating hormone peptides, morphiceptin peptides, motilin peptides, neuro-peptides, neuropeptide Y peptides, neurotropic factor peptides, orexin peptides, opioid peptides, oxytocin peptides, PACAP peptides, pancreastatin peptides, pancreatic polypeptides, parathyroid hormone peptides, parathyroid hormone-related peptides, peptide T peptides, prolactin-releasing peptides, peptide YY peptides, renin substrate peptides, secretin peptides, somatostatin peptides, substance P peptides, tachykinin peptides, thyrotropin-releasing hormone peptides, toxin peptides, vasoactive intestinal peptides, vasopressin peptides, and virus related peptides. (see U.S. Pat. No. 6,858,580).

Examples of polypeptides include, but are not limited to, pituitary hormones such as vasopressin, oxytocin, melanocyte stimulating hormones, adrenocorticotropic hormones, growth hormones; hypothalamic hormones such as growth hormone releasing factor, corticotropin releasing factor, prolactin releasing peptides, gonadotropin releasing hormone and its associated peptides, luteinizing hormone release hormones, thyrotropin releasing hormone, orexins, and somatostatin; thyroid hormones such as calcitonins, calcitonin precursors, and calcitonin gene related peptides; parathyroid hormones and their related proteins; pancreatic hormones such as insulin and insulin-like peptides, glucagon, somatostatin, pancreatic polypeptides, amylin, peptide YY, and neuropeptide Y; digestive hormones such as gastrin, gastrin releasing peptides, gastrin inhibitory peptides, cholecystokinin, secretin, motilin, and vasoactive intestinal peptide; natriuretic peptides such as atrial natriuretic peptides, brain natriuretic peptides, and C-type natriuretic peptides; neurokinins such as neurokinin A, neurokinin B, and substance P; renin related peptides such as renin substrates and inhibitors and angiotensins; endothelins, including big endothelin, endothelin A receptor antagonists, and sarafotoxin peptides; and other peptides such as adrenomedullin peptides, allatostatin peptides, amyloid beta protein fragments, antibiotic and antimicrobial peptides, apoptosis related peptides, bag cell peptides, bombesin, bone Gla protein peptides, CART peptides, chemotactic peptides, cortistatin peptides, fibronectin fragments and fibrin related peptides. FMRF and analog peptides, galanin and related peptides, growth factors and related peptides, G therapeutic peptide-binding protein fragments, guanylin and uroguanylin, inhibin peptides, interleukin and interleukin receptor proteins, laminin fragments, leptin fragment peptides, leucokinins, mast cell degranulating peptides, pituitary adenylate cyclase activating polypeptides, pancreastatin, peptide T, polypeptides, virus related peptides, signal transduction reagents, toxins, and miscellaneous peptides such as adjuvant peptide analogs, alpha mating factor, antiarrhythmic peptide, antifreeze polypeptide, anorexigenic peptide, bovine pineal antireproductive peptide, bursin, C3 peptide P16, tumor necrosis factor, cadherin peptide, chromogranin A fragment, contraceptive tetrapeptide, conantokin G, conantokin T, crustacean cardioactive peptide, C-telopeptide, cytochrome b588 peptide, decorsin, delicious peptide, delta-sleep-inducing peptide, diazempam-binding inhibitor fragment, nitric oxide synthase blocking peptide, OVA peptide, platelet calpain inhibitor (P1), plasminogen activator inhibitor 1, rigin, schizophrenia related peptide, serum thymic factor, sodium potassium A therapeutic peptidease inhibitor-1, speract, sperm activating peptide, systemin, thrombin receptor agonists, thymic humoral gamma2 factor, thymopentin, thymosin alpha 1, thymus factor, tuftsin, adipokinetic hormone, uremic pentapeptide, glucose-dependent insulinotropic polypeptide (GIP), glucagon-like peptide-1 (GLP-1), glucagon-like peptide-2 (GLP-1), exendin-3, exendin-4, and other therapeutic peptides or fragments thereof. Additional examples of peptides include ghrelin, opioid peptides (casomorphin peptides, demorphins, endorphins, enkephalins, deltorphins, dynorphins, and analogs and derivatives of these), thymic peptides (thymopoietin, thymulin, thymopentin, thymosin, Thymic Humoral Factor (THF)), cell adhesion peptides, complement inhibitors, thrombin inhibitors, trypsin inhibitors, alpha-1 antitrypsin, Sea Urchin Sperm Activating Peptide, Asterosap, SHU-9119 MC3-R & MC4-R Antagonist, glaspimod (immunostimulant, useful against bacterial infections, fungal infections, immune deficiency immune disorder, leukopenia), HP-228 (melanocortin, useful against chemotherapy induced emesis, toxicity, pain, diabetes mellitus, inflammation, rheumatoid arthritis, obesity), alpha 2-plasmin inhibitor (plasmin inhibitor), APC tumor suppressor (tumor suppressor, useful against neoplasm), early pregnancy factor (immunosuppressor), endozepine diazepam binding inhibitor (receptor peptide), gamma interferon (useful against leukemia), glandular kallikrein-1 (immunostimulant), placental ribonuclease inhibitor, sarcolecin binding protein, surfactant protein D, Wilms' tumor suppressor, GABAB 1b receptor peptide, prion related peptide (iPrP13), choline binding protein fragment (bacterial related peptide), telomerase inhibitor, cardiostatin peptide, endostatin derived peptide (angiogenesis inhibitor), prion inhibiting peptide, N-methyl D-aspartate receptor antagonist, C-peptide analog (useful against diabetic complications), RANTES, NTY receptors, NPY2-R (neuropeptide Y type 2-receptor) ligands, NC4R peptides, or fragments thereof. Other analogs and polypeptides upon which the analogs of the instant invention are derived are found in U.S. Pat. No. 6,849,714 which is incorporated by reference herein.

The hormones regulating insulin secretion belong to the so-called enteroinsular axis, designating a group of hormones released from the gastrointestinal mucosa in response to the presence and absorption of nutrients in the gut, which promote an early and potentiated release of insulin. The enhancing effect on insulin secretion, the so-called incretin effect, is probably essential for a normal glucose tolerance. Many of the gastrointestinal hormones, including gastrin and secretin (cholecystokinin is not insulinotropic in man), are insulinotropic, but the only physiologically important ones, those that are responsible for the incretin effect, are the glucose-dependent insulinotropic polypeptide, GIP, and glucagon-like peptide-1 (GLP-1).

GIP is composed of 42 amino acids, processed from a 153 amino acid precursor (Takeda et al., PNAS USA (1987) 84:7005-7008). GIP is secreted by K cells present in the duodenum and in the small intestinal mucosa in response to carbohydrate and lipid containing meals (Mortensen et al. Ann. NY Acad. Sci. (2000) 921:469-472). Expression of the GIP receptor has been shown in pancreatic islets, the adrenal cortex, gut, heart, adipose tissue, several regions of the brain, and the pituitary gland (Usdin et al. (1993) Endocrinology 133:2861-2870).

Because of its insulinotropic effect, GIP, isolated in 1973 (Pederson R A. Gastric Inhibitory Polypeptide. In Walsh J H, Dockray G J (eds.) Gut peptides: Biochemistry and Physiology. Raven Press, New York 1994, pp. 217-259) immediately attracted considerable interest among diabetologists. However, numerous investigations carried out during the following years clearly indicated that a defective secretion of GIP was not involved in the pathogenesis of insulin dependent diabetes mellitus (IDDM) or non insulin-dependent diabetes mellitus (NIDDM) (Krarup T., Endocr Rev 1988; 9: 122-134). Furthermore, as an insulinotropic hormone, GIP was found to be almost ineffective in NIDDM (Krarup T., Endocr Rev 1988; 9: 122-134). The other incretin hormone, GLP-1 is the most potent insulinotropic substance known (O'rskov C., Diabetologia 1992; 35:701-711). Unlike GIP, it is surprisingly effective in stimulating insulin secretion in NIDDM patients. In addition, and in contrast to the other insulinotropic hormones (perhaps with the exception of secretin), it also potently inhibits glucagon secretion. Because of these actions, it has pronounced blood glucose lowering effects particularly in patients with NIDDM.

GLP-1, a product of the proglucagon gene (Bell G I, et al., Nature 1983; 304: 368-371), is one of the members of the secretin-VIP family of peptides, and is established as an important gut hormone with regulatory function in glucose metabolism and gastrointestinal secretion and metabolism (Hoist J J., 1994; Gastroenterology. 1994 December; 107 (6):1848-55). The glucagon gene is processed differently in the pancreas and in the intestine. In the pancreas (Hoist J J, et al., J Biol Chem, 1994; 269: 18827-18833), the processing leads to the formation and parallel secretion of 1) glucagon itself, occupying positions 33-61 of proglucagon (PG); 2) an N-terminal peptide of 30 amino acids (PG (1-30)) often called glicentin-related pancreatic peptide, GRPP (Moody A J, et al., Nature 1981; 289: 514-516; Thim L, et al., Biochim Biophys Acta 1982; 703:134-141); 3) a hexapeptide corresponding to PG (64-69); 4) and, finally, the so-called major proglucagon fragment (PG (72-158)), in which the two glucagon-like sequences are buried (Hoist J J, et al., J Biol Chem, 1994; 269: 18827-18833). Glucagon seems to be the only biologically active product. In contrast, in the intestinal mucosa, it is glucagon that is buried in a larger molecule, while the two glucagon-like peptides are formed separately (O'rskov C, et al., Endocrinology 1986; 119:1467-1475). The following products are formed and secreted in parallel: 1) glicentin, corresponding to PG (1-69), with the glucagon sequence occupying residues Nos. 33-61 (Thim L, et al., Regul Pept 1981; 2:139-151); 2) GLP-1(7-36)amide (PG (78-107))amide (O'rskov C, et al., J. Biol. Chem. 1989; 264:12826-12829), not as originally believed PG (72-107) amide or 108, which is inactive). Small amounts of C-terminally glycine-extended but equally bioactive GLP-1(7-37), (PG (78-108)) are also formed (Orskov C, et al., Diabetes 1991; 43: 535-539); 3) intervening peptide-2 (PG (111-122)amide) (Buhl T, et al., J. Biol. Chem. 1988; 263:8621-8624); and 4) GLP-2 (PG (126-158)) (Buhl T, et al., J. Biol. Chem. 1988; 263:8621-8624; O'rskov C, et al., FEBS letters, 1989; 247:193-106). A fraction of glicentin is cleaved further into GRPP (PG (1-30)) and oxyntomodulin (PG (33-69)) (Hoist J J. Biochem J. 1980; 187:337-343; Bataille D, et al., FEBS Lett 1982; 146:79-86).

Being secreted in parallel with glicentin/enteroglucagon, it follows that the many studies of enteroglucagon secretion (Hoist J J., Gastroenterology 1983; 84:1602-1613; Hoist J J, et al., Glucagon and other proglucagon-derived peptides. In Walsh J H, Dockray G J, eds. Gut peptides: Biochemistry and Physiology. Raven Press, New York, pp. 305-340, 1993) to some extent also apply to GLP-1 secretion, but GLP-1 is metabolized more quickly with a plasma half-life in humans of 2 minutes (O'rskov C, et al., Diabetes 1993; 42:658-661). Carbohydrate or fat-rich meals stimulate secretion (Elliott R M, et al., J Endocrinol 1993; 138: 159-166), presumably as a result of direct interaction of yet unabsorbed nutrients with the microvilli of the open-type L-cells of the gut mucosa.

The incretin function of GLP-1(29-31) has been clearly illustrated in experiments with the GLP-1 receptor antagonist, exendin 9-39, which dramatically reduces the incretin effect elicited by oral glucose in rats (Kolligs F, et al., Diabetes 1995 44: 16-19; Wang Z, et al., J. Clin. Invest. 1995 95: 417-421). The hormone interacts directly with the β-cells via the GLP-1 receptor (Thorens B., Proc Natl Acad Sci 1992; 89:8641-4645, U.S. Pat. Nos. 5,670,360 and 6,051,689, which are incorporated by reference herein) which belongs to the glucagon/VIP/calcitonin family of G-protein-coupled 7-transmembrane spanning receptors. The importance of the GLP-1 receptor in regulating insulin secretion was illustrated in recent experiments in which a targeted disruption of the GLP-1 receptor gene was carried out in mice. Animals homozygous for the disruption had greatly deteriorated glucose tolerance and fasting hyperglycaemia, and even heterozygous animals were glucose intolerant (Scrocchi L, et al., Diabetes 1996; 45: 21A). The signal transduction mechanism (Fehmann H C, et al., Endocrine Reviews, 1995; 16: 390-410) primarily involves activation of adenylate cyclase, but elevations of intracellular $Ca^{2+}$ are also essential (Fehmann H C, et al., Endocrine Reviews, 1995; 16: 390-410; Gromada J, et al., Diabetes 1995; 44: 767-774). A model of GLP-1 receptor-ligand interaction is shown in Lopez de Maturana, R. et al. (2003) J. Biol. Chem. 278, 10195-10200. Lopez de Maturana et al. indicate that the N-terminal domain of the receptor binds to the conserved face of the central helix of exendin-4, GLP-1, and exendin (9-39). The N-terminal regions of exendin-4 and GLP-1 interact with the extracellular loops and/or the transmembrane regions of the GLP-1R. Also the N-terminal domain of the receptor interacts with the Trp-cage portion of the exendin-4 and exendin (9-39). Neidigh et al. Nature Structural Biology (2002) 9(6):425-430 describe the Trp-cage structure of Exendin-4 and mutants thereof.

The action of the hormone is best described as a potentiation of glucose stimulated insulin release (Fehmann H C, et al., Endocrine Reviews, 1995; 16: 390-410), but the mechanism that couples glucose and GLP-1 stimulation is not known. It may involve a calcium-induced calcium release (Gromada J, et al., Diabetes 1995; 44: 767-774; Holz G G. et al., J Biol Chem, 1996; 270: 17749-17759). As already mentioned, the insulinotropic action of GLP-1 is preserved in diabetic β-cells. The relation of the latter to its ability to convey "glucose competence" to isolated insulin-secreting cells (Gromada J, et al., Diabetes 1995, 44: 767-774; Holz G G, et al., Nature 1993, 361:362-365), which respond poorly to glucose or GLP-1 alone, but fully to a combination of the two, is also not known. Equally importantly, however, the hormone also potently inhibits glucagon secretion (O'rskov C, et al., Endocrinology 1988; 123:2009-2013). The mechanism is not known, but seems to be paracrine, via neighbouring insulin or somatostatin cells (Fehmann H C, et al., Endocrine Reviews, 1995; 16: 390-410). Also the glucagonostatic action is glucose-dependent, so that the inhibitory effect decreases as blood glucose decreases. Because of this dual effect, if the plasma GLP-1 concentrations increase either by increased secretion or by exogenous infusion, the molar ratio of insulin to glucagon in the blood that reaches the liver via the portal circulation is greatly increased, whereby hepatic glucose production decreases (Hvidberg A, et al., Metabolism 1994; 43:104-108). As a result blood glucose concentrations decrease. Because of the glucose dependency of the insulinotropic and glucagonostatic actions, the glucose lowering effect is self-limiting, and the hormone, therefore, does not cause hypoglycaemia regardless of dose (Qualmann C, et al., Acta Diabetologica, 1995; 32: 13-16). The effects are preserved in patients with diabetes mellitus (Nauck M A, et al., J Clin Invest 1993; 91:301-307), in whom infusions of slightly supraphysiological doses of GLP-1 may completely normalise blood glucose values in spite of poor metabolic control and secondary failure to sulphonylurea (Nauck M A, et al., Diabetologia 1993; 36:741-744). The importance of the glucagonostatic effect is illustrated by the finding that GLP-1 also lowers blood glucose in type-I diabetic patients without residual β-cell secretory capacity (Creutzfeldt W, et al., Diabetes Care 1996; 19: 580-586).

GLP-1 is involved in increasing beta-cell mass as well as regulating beta-cell differentiation, beta-cell proliferation and beta-cell survival (Stoffers D A, Horm Metab Res. 2004 November-December; 36(11-12):811-21), and has a role in increasing proinsulin gene transcription and biosynthesis.

In addition to its effects on the pancreatic islets, GLP-1 has powerful actions on the gastrointestinal tract. Infused in physiological amounts, GLP-1 potently inhibits pentagastrin-induced as well as meal-induced gastric acid secretion (Schjoldager B T G, et al., Dig. Dis. Sci. 1989; 35:703-708; Wettergren A, et al., Dig Dis Sci 1993; 38:665-673). It also inhibits gastric emptying rate and pancreatic enzyme secretion (Wettergren A., et al., Dig Dis Sci 1993; 38:665-673). Similar inhibitory effects on gastric and pancreatic secretion and motility may be elicited in humans upon perfusion of the ileum with carbohydrate- or lipid-containing solutions (Layer P, et al., Dig Dis Sci 1995; 40: 1074-1082; Layer P, et al., Digestion 1993; 54: 385-386). Concomitantly, GLP-1 secretion is greatly stimulated, and it has been speculated that GLP-1 may be at least partly responsible for this so-called "ileal-brake" effect (Layer P, et al., Digestion 1993; 54: 385-386). In fact, recent studies suggest that, physiologically, the ileal-brake effects of GLP-1 may be more important than its effects on the pancreatic islets. Thus, in dose response studies GLP-1 influences gastric emptying rate at infusion rates at least as low as those required to influence islet secretion (Nauck M, et al., Gut 1995; 37 (suppl. 2): A124).

GLP-1 seems to have an effect on food intake. Intraventricular administration of GLP-1 profoundly inhibits food intake in rats (Schick R R, vorm Walde T, Zimmermann J P, Schusdziarra V, Classen M. Glucagon-like peptide 1—a novel brain peptide involved in feeding regulation. in Ditschuneit H, Gries F A, Hauner H, Schusdziarra V, Wechsler J G (eds.) Obesity in Europe. John Libbey & Company Ltd., 1994; pp. 363-367; 42). This effect seems to be highly specific. Thus, N-terminally extended GLP-1 (PG 72-107) amide is inactive and appropriate doses of the GLP-1 antagonist, exendin 9-39, abolish the effects of GLP-1. Acute, peripheral administration of GLP-1 does not inhibit food intake acutely in rats (Turton M D, et al., Nature 1996; 379: 69-72). However, it remains possible that GLP-1 secreted from the intestinal L-cells may also act as a satiety signal.

Not only the insulinotropic effects but also the effects of GLP-1 on the gastrointestinal tract are preserved in diabetic patients (Willms B, et al., Diabetologia 1994; 37, suppl.1: A118), and may help curtailing meal-induced glucose excursions, but, more importantly, may also influence food intake. Administered intravenously, continuously for one week, GLP-1 at 4 ng/kg/min has been demonstrated to dramatically improve glycaemic control in NIDDM patients without significant side effects (Larsen J, et al., Diabetes 1996; 45, suppl. 2: 233A). The peptide is fully active after subcutaneous administration (Ritzel R, et al., Diabetologia 1995; 38: 720-725), but is rapidly degraded mainly due to degradation by dipeptidyl peptidase IV-like enzymes (Deacon C F, et al., J Clin Endocrinol Metab 1995; 80: 952-957; Deacon C F, et al., Diabetes 44: 1126-1131).

The amino acid sequence of GLP-1 is disclosed in Schmidt et al. (Diabetologia 28 704-707 (1985). Human GLP-1 is a 30-31 amino acid residue peptide originating from preproglucagon which is synthesized, i.a. in the L-cells in the distal ileum, in the pancreas and in the brain. Processing of preproglucagon to GLP-1(7-36)amide, GLP-1(7-37) and GLP-2 occurs mainly in the L-cells. Although the interesting pharmacological properties of GLP-1(7-37) and analogues thereof have attracted much attention in recent years only little is known about the structure of these molecules. The secondary structure of GLP-1 in micelles has been described by Thorton et al. (Biochemistry 33: 3532-3539 (1994)), but in normal solution, GLP-1 is considered a very flexible molecule. Derivatisation of this relatively small and very flexible molecule resulted in compounds whose plasma profile were highly protracted and still had retained activity.

GLP-1 and analogues of GLP-1 and fragments thereof are useful i.a. in the treatment of Type 1 and Type 2 diabetes and obesity.

WO 87/06941 discloses GLP-1 fragments, including GLP-1(7-37), and functional derivatives thereof and to their use as an insulinotropic agent. GLP-1(7-37), certain derivatives thereof and the use thereof to treat Diabetes mellitus in a mammal are disclosed in U.S. Pat. No. 5,120,712, which is incorporated by reference herein.

WO 90/11296 discloses GLP-1 fragments, including GLP-1(7-36), and functional derivatives thereof which have an insulinotropic activity which exceeds the insulinotropic activity of GLP-1(1-36) or GLP-1(1-37) and to their use as insulinotropic agents.

The amino acid sequence of GLP-1(7-36) and GLP-1(7-37) is: His-Ala-Glu-Gly-Thr-Phe-Thr-Ser-Asp-Val-Ser-Ser-Tyr-Leu-Glu-Gly-Gln-Ala-Ala-Lys-Glu-Phe-Ile-Ala-Trp-Leu-Val-Lys-Gly-Arg-X, wherein X is $NH_2$ for GLP-1(7-36) (SEQ ID NO: 1330) and X is Gly for GLP-1(7-37) (SEQ ID NO: 1331).

WO 91/11457 discloses analogues of the active GLP-1 peptides 7-34, 7-35, 7-36, and 7-37 which can also be useful as GLP-1 moieties.

EP 0708179-A2 discloses GLP-1-like polypeptides and derivatives that include an N-terminal imidazole group and optionally an unbranched $C_6$-$C_{10}$ acyl group in attached to the lysine residue in position 34.

EP 0699686-A2 discloses certain N-terminal truncated fragments of GLP-1 that are reported to be biologically active.

In some embodiments the compositions, pharmaceutical compositions comprise analogs, wherein the analog amino acid sequence is based upon the GLP-1 fragments, polypeptides, and functional deriviatives disclosed above.

Another example of a peptide is T-20 (DP-178) which is a peptide corresponding to amino acids 638 to 673 of the HIV-1$_{LAI}$ transmembrane protein (TM) gp41, the carboxyl-terminal helical segment of the extracellular portion of gp41. The extracellular portion of gp41 has another .alpha.-helical region which is the amino-terminal proposed zipper domain, DP-107, DP-107 exhibits potent antiviral activity by inhibiting viral fusion. It is a 38 amino acid peptide, corresponding to residues 558 to 595 of the HIV-1$_{LAI}$ transmembrane gp41 protein. Studies with DP-107 have proven both are non-toxic in in vitro studies and in animals. U.S. Pat. No. 5,656,480, which is incorporated by reference herein, describes DP-107 and its antiviral activity. In some embodiments the compositions, pharmaceutical compositions comprise analogs, wherein the analog amino acid sequence is based upon the DP-107 fragments, polypeptides, and functional deriviatives disclosed.

T-20 inhibits entry of HIV into cells by acting as a viral fusion inhibitor. The fusion process of HIV is well characterized. HIV binds to CD4 receptor via gp120, and upon binding to its receptor, gp120 goes through a series of conformational changes that allows it to bind to its coreceptors, CCR5 or CXCR4. After binding to both receptor and coreceptor, gp120 exposes gp41 to begin the fusion process. gp41 has two regions named heptad repeat 1 and 2 (HR1 and 2). The extracellular domain identified as HR1 is an β.-helical region which is the amino-terminal of a proposed zipper domain. HR1 comes together with HR2 of gp41 to form a hairpin. The structure that it is formed is a α-helix bundle that places the HIV envelope in the proximity of the cellular membrane causing fusion between the two membranes. T-20 prevents the conformational changes necessary for viral fusion by binding the first heptad-repeat (HR1) of the gp41 transmembrane glycoprotein. Thus, the formation of the 6-helix bundle is blocked by T-20's binding to the HR1 region of gp41. The DP107 and DP178 domains (i.e., the HR1 and HR2 domains) of the HIV gp41 protein non-covalently complex with each other, and their interaction is required for the normal infectivity of the virus. Compounds that disrupt the interaction between DP107 and DP178, and/or between DP107-like and DP178-like peptides are antifusogenic, including antiviral.

DP-178 acts as a potent inhibitor of HIV-1 mediated CD-4$^+$ cell-cell fusion (i.e., syncytial formation) and infection of CD-4$^+$ cells by cell-free virus. Such anti-retroviral activity includes, but is not limited to, the inhibition of HIV transmission to uninfected CD-4$^+$ cells. DP-178 act at low concentrations, and it has been proven that it is non-toxic in in vitro studies and in animals. The amino acid conservation within the DP-178—corresponding regions of HIV-1 and HIV-2 has been described.

Potential uses for DP-178 peptides are described in U.S. Pat. Nos. 5,464,933 and 6,133,418, as well as U.S. Pat. Nos. 6,750,008 and 6,824,783, all of which are incorporated by reference herein, for use in inhibition of fusion events associated with HIV transmission.

Portions and homologs of DP178 and DP-107 as well as modulators of DP178/DP107, DP178-like/DP107-like or HR1/HR2 interactions have been investigated that show antiviral activity, and/or show anti-membrane fusion capability, or an ability to modulate intracellular processes involving coiled-coil peptide structures in retroviruses other than HIV-1 and nonretroviral viruses. Viruses in such studies include, simian immunodeficiency virus (U.S. Pat. No. 6,017,536), respiratory synctial virus (U.S. Pat. Nos. 6,228,983; 6,440,656; 6,479,055; 6,623,741), Epstein-Barr virus (U.S. Pat. Nos. 6,093,794; 6,518,013), parainfluenza virus (U.S. Pat. No. 6,333,395), influenza virus (U.S. Pat. Nos. 6,068,973; 6,060,065), and measles virus (U.S. Pat. No. 6,013,263). All of which are incorporated by reference herein.

A commercially available form of DP-178 is Fuzeon® (enfuvirtide, Roche Laboratories Inc. and Trimeris, Inc.). Fuzeon® has an acetylated N terminus and a carboxamide as the C-terminus, and is described by the following primary amino acid sequence: $CH_3CO$-YTSLIHSLIEESQN-QQEKNEQELLELDKWASLWNWF-$NH_2$ (SEQ ID NO: 784). It is used in combination with other antivirals in HIV-1 patients that show HIV-1 replication despite ongoing antiretroviral therapy.

U.S. Pat. Nos. 5,464,933 and 6,824,783, which are incorporated by reference herein, describes DP-178, DP-178 fragments and homologs, including, but not limited to, molecules with amino and carboxy terminal truncations, substitutions, insertions, deletions, additions, or macromolecular carrier groups as well as DP-178 molecules with chemical groups such as hydrophobic groups present at their amino and/or carboxy termini. Additional variants, include but are not limited to, those described in U.S. Pat. No. 6,830,893 and the derivatives of DP-178 disclosed in U.S. Pat. No. 6,861,059. A set of T-20 hybrid polypeptides are described in U.S. Pat. Nos. 6,656,906, 6,562,787, 6,348,568 and 6,258,782, and a DP-178-toxin fusion is described in U.S. Pat. No. 6,627,197. In some embodiments the compositions, pharmaceutical compositions comprise analogs, wherein the analog amino acid sequence is based upon the T-20 and DP-178 fragments, polypeptides, and functional deriviatives disclosed above.

HAART (Highly Active Anti-Retroviral Therapy) is the standard of therapy for HIV which combines drugs from a few classes of antiretroviral agents to reduce viral loads. U.S. Pat. No. 6,861,059, which is incorporated by reference herein, discloses methods of treating HIV-1 infection or inhibiting HIV-1 replication employing DP-178 or DP-107 or derivatives thereof, in combination with at least one other antiviral therapeutic agent such as a reverse transcriptase inhibitor (e.g. AZT, ddI, ddC, ddA, d4T, 3TC, or other dideoxynucleotides or dideoxyfluoronucleosides) or an inhibitor of HIV-1 protease (e.g. indinavir; ritonavir). Other antivirals include cytokines (e.g., rIFN.alpha., rIFN.beta., rIFN.gamma.), inhibitors of viral mRNA capping (e.g. ribavirin), inhibitors of HIV protease (e.g. ABT-538 and MK-639), amphotericin B as a lipid-binding molecule with anti-HIV activity, and castanospermine as an inhibitor of glycoprotein processing. In some embodiments, the pharmaceutical compositions comprises an analog of T20, wherein the analog amino acid sequence is based upon the T20 fragments, polypeptides, and functional deriviatives disclosed above. In some embodiments, the pharmaceutical composition comprises an analog of T20, wherein the analog amino acid sequence is based upon the T20 fragments, polypeptides, and functional deriviatives disclosed above and one other anti-viral agent. In some embodiments the pharmaceutical composition of the claimed invention comprises one another anti-viral agent chosen from the following: reverse transcriptase inhibitors, integrase inhibitors, protease inhibitors, cytokine antagonists, and chemokine receptor modulators described U.S. Pat. Nos. 6,855,724; 6,844,340; 6,841,558; 6,833,457; 6,825,210; 6,811,780; 6,809,109; 6,806,265; 6,768,007; 6,750,230; 6,706,706; 6,696,494; 6,673,821; 6,673,791; 6,667,314; 6,642,237; 6,599,911; 6,596,729; 6,593,346; 6,589,962; 6,586,430; 6,541,515; 6,538,002; 6,531,484; 6,511,994; 6,506,777; 6,500,844; 6,498,161; 6,472,410; 6,432,981; 6,410,726; 6,399,619; 6,395,743; 6,358,979; 6,265,434; 6,248,755; 6,245,806; and 6,172,110, which are incorporated by reference.

Potential delivery systems for DP-178 include, but are not limited to those described in U.S. Pat. Nos. 6,844,324 and 6,706,892. In addition, a process for producing T-20 in inclusion bodies was described in U.S. Pat. No. 6,858,410.

T20/DP178, T21/DP107, and fragments thereof have also been found to interact with N-formyl peptide receptor (FPR members). T-20 activates the N-formyl peptide receptor present in human phagocytes (Su et al. (1999) Blood 93(11): 3885-3892) and is a chemoattractant and activator of monocytes and neutrophils (see U.S. Pat. No. 6,830,893). The FPR class receptors are G-protein-coupled, STM receptors that bind the chemoattractant fMLP (N-formyl-methionyl-leucyl-phenylalanine) and are involved in monocyte chemotaxis and the induction of a host immune response to a pathogen. The prototype FPR class receptor, FPR, binds fMLP with high affinity and is activated by low concentrations of fMLP. The binding of FPR by fMLP induces a cascade of G protein-mediated signaling events leading to phagocytic cell adhesion, chemotaxis, release of oxygen intermediates, enhanced phagocytosis and bacterial killing, as well as MAP kinase activation and gene transcription. (Krump et al., J Biol Chem 272:937 (1997); Prossnitz et al., Pharmacol Ther 74:73 (1997); Murphy, Annu. Rev. Immuno. 12: 593 (1994); and Murphy, The N-formyl peptide chemotactic receptors, Chemoattractant ligands and their receptors. CRC Press, Boca Raton, p. 269 (1996)). Another FPR class receptor is the highly homologous variant of FPR, named FPRL1 (also referred to as FPRH2 and LXA4R). FPRL1 was originally cloned as an orphan receptor (Murphy et al., J. Biol. Chem., 267:7637-7643 (1992); Ye et al., Biochem. Biophys. Res. Commun., 184:582-589 (1992); Bao et al., Genomics, 13:437-440 (1992); Gao, J. L. and P. M. Murphy, J. Biol. Chem., 268:25395-25401 (1993); and Nomura et al., Int. Immunol., 5:1239-1249 (1993)) but was subsequently found to mediate $Ca^{2+}$ mobilization in response to high concentrations of fMLP. (Ye et al., Biochem. Biophys. Res. Commun., 184:582-589 (1992); and Gao, J. L. and P. M. Murphy, J. Biol. Chem. 268:25395-25401 (1993)). In some embodiments, the invention relates to a method of modulating an FPR member or CCR5 by:

a) contacting the FPR member or CCR5 molecule with a T20 analog, wherein said analog comprises an α-amino acid and at least one β-amino acid;

b) measuring the association of the T20 analog to the FPR member or CCR5 in the presence and absence of an unknown compound; and c) comparing the rate of association of the T20 analog to the FPR member or CCR5 in the presence of an unknown compound to the rate of association of the T20 analog to the FPR member or CCR5 in the absence of an unknown compound.

The chemokine receptor CCR5 is another G-protein-coupled, STM receptor and is a major fusion-cofactor exploited by most primary isolates of the human immunodeficiency virus type 1 (HIV-1). (Al Khatib et al., Science 1996, 272:1955; Doranz et al., Cell 1996, 85:1149; Deng et al., Nature 1996, 381:661; Dragic et al., Nature 1996; 381:667; Horuk, Immunol Today, 20:89 (1999); Dimitrov and Broder, "HIV and Membrane Receptors," HIV and membrane fusion: Medical Intelligence Unit, Landes Bioscience, Austin, Tex., 1997:99; and Berger, AIDS 11, Suppl A: S3 (1997)). Individuals that fail to express CCR5 are largely resistant to HIV-1 infection. (Liu et al., Cell 1996, 86:367-77; Huang, Y, Nat Med 1996, 2:1240; Dean, et al., Science, 273:1856 (1996)). Due to its prominent role in HIV-1 fusion and entry, investigators have focused considerable research on developing molecules that interrupt the interaction between the HIV-1 envelope and CCR5. Chemokine ligands and antibodies specific for CCR5, for example, have been shown to inhibit HIV-1 entry and replication. (Cocchi et al., Science, 270:1811 (1995); Wu et al., J Exp Med, 186: 373 (1997); Proudfoot et al., J Biol Chem, 271:2599 (1996); Arenzana-Seisdedos et al., Nature, 383:400 (1996); Gong et al., J Biol Chem, 273:4289 (1998)). U.S. Pat. No. 6,808,877 discusses DP-178 and its role in phosphorylation and downregulation of CCR5 and/or the inhibition of HIV infection by acting as a ligand to the N-formyl peptide receptor.

Peptide YY (PYY) is a thirty six amino acid long peptide, first isolated from porcine intestinal tissue and mainly localized in intestinal endocrine cells. PYY is secreted postprandially by endocrine cells of the distal gastrointestinal tract and acts at the hypothalamus signaling satiety. See Batterham, R. L. et al., Nature 418:650-654 (2002), which is incorporated by reference herein. It has many biological activities, including a range of activities within the digestive system and potent inhibition of intestinal electrolyte and fluid secretion. Like its relatives, neuropeptide Y (NPY) and pancreatic polypeptide (PP), peptide YY (PYY) is bent into hairpin configuration that is important in bringing the free ends of the molecule together for binding to the receptors.

Recent studies have shown that fasting and postprandial PYY levels are low in obese subjects, which may account for their high appetite and food consumption. When administered intravenously, it suppresses appetite and food intake in both lean and obese subjects (Batterham, R. L. et al., N Engl J Med 349:941-948 (2003)). Other peptides from the pancreatic peptide (PP) family, like peptide YY fragments (e.g. PYY {3-36}), and PYY agonists (including those not in the PP family) also suppress appetite. Its oral activity, however, is negligible due to its low absorption and rapid degradation in the gastrointestinal tract. PYY {3-36} is identified as Ile Lys pro Glu Ala Pro Gly Glu ASp Ala Ser Pro Glu Glu Leu Asn Arg Tyr Tyr Ala Ser Leu Arg His Tyr Leu Asn Leu val Thr Arg Gln Arg Tyr; Eberlein, Eysselein et al., Peptides 10:797-803 (1989); and Grandy, Schimiczek et al., Regul Pept 51:151-9 (1994), which are incorporated by reference herein.

PYY {3-36} has a sequence identical to PYY over amino acids 3 to 36. PYY {3-36} contains approximately 40% of total peptide YY-like immunoreactivity in human and canine intestinal extracts and about 36% of total plasma peptide YY immunoreactivity in a fasting state to slightly over 50% following a meal. It is apparently a dipeptidyl peptidase-IV (DPP4) cleavage product of peptide YY. Peptide YY {3-36} is reportedly a selective ligand at the Y2 and Y5 receptors, which appear pharmacologically unique in preferring N-terminally truncated (i.e. C terminal fragments of) neuropeptide Y analogs. A PYY agonist may bind to a PYY receptor with higher or lower affinity, demonstrate a longer or shorter half-life in vivo or in vitro, or be more or less effective than native PYY. In some embodiments a functional fragment of PYY {3-36} is a fragment of the above sequence that shares the immunoreactivity in human and canine intestinal extracts.

Current antiobesity drugs have limited efficacy and numerous side effects. Crowley, V. E., Yeo, G. S. & O'Rahilly, S., Nat. Rev. Drug Discov 1, 276-86 (2002). With obesity reaching epidemic proportions worldwide, there is a pressing need for the development of adequate therapeutics in this area. In recent years, hormones and neuropeptides involved in the regulation of appetite, body energy expenditure, and fat mass accumulation such as PYY have emerged as potential antiobesity drugs. See McMinn, J. E., Baskin, D. G. & Schwartz, M. W., Obes Rev 1:37-46 (2000), Drazen, D. L. & Woods, S. C., Curr Opin Clin Nutr Metab Care 6:621-629 (2003), which are incorporated by reference herein.

According to Batterham et al., Nature 418:650-654 (2002), which is hereby incorporated by reference, the peptide YY {3-36} system may provide a therapeutic target for the treatment of obesity. International Publication No. WO 02/47712 and U.S. Patent Application Publication No. 2002/0141985 disclose methods for treating obesity and diabetes with peptide YY and peptide YY agonists, such as peptide YY {3-36}. U.S. Patent Application Publication No. 20050002927 describes the use of at least one Y2 receptor-binding peptide, such as peptide YY, Neuropeptide Y (NPY) or Pancreatic Peptide (PP) for treating a variety of diseases and conditions in mammalian subjects such as obesity and epilepsy. In some embodiments the compositions, pharmaceutical compositions comprise analogs, wherein the analog amino acid sequence is based upon the PPY or the peptide YY {3-36} fragments, polypeptides, and functional deriviatives disclosed above. In some embodiments, the invention relates to a pharmaceutical composition that comprise a PPY or peptide YY {3-36} analog, wherein the analog amino acid sequence is based upon the fragments, polypeptides, and functional deriviatives disclosed above for treatment of obesity, diabetes, seizures associated with temporal lobe epilepsy, ulcers, irritable bowel disease and inflammatory bowel disease according to the dosing regimens disclosed below.

In some embodiments, the compositions of the claimed invention comprise analog of PYY(3-36), AC162352, Neuropeptide Y (NPY) (U.S. Pat. No US 2005/0136036 A1).

In addition, treatment with DPP-IV inhibitors prevents degradation of Peptide YY which has been linked to gastrointestinal conditions such as ulcers, irritable bowel disease and inflammatory bowel disease. Peptide YY and its analogs or agonists have been used to manipulate endocrine regulation of cell proliferation, nutrient transport, and intestinal water and electrolyte secretion. (U.S. Pat. No. 5,604, 203; WO9820885A1; EP692971A1; U.S. Pat. No. 5,912, 227, which are incorporated herein by reference). A role for peptide YY in the regulation of intestinal motility, secretion, and blood flow has also been suggested, as well as its use in a treatment of malabsorptive disorders. Analogs of PYY have been reported that emulate and enhance the duration, effect, biological activity and selectivity of the natural peptide in the treatment of pancreatic tumors (See U.S. Pat. No. 5,574,010, incorporated herein by reference).

Other suitable PYY agonists include those described in International Publication No. WO 98/20885, which is hereby incorporated by reference.

In one aspect, the invention provides a method of treating obesity in an obese or overweight animal by administering a therapeutically effective amount of PYY analog, a PYY agonist analog, or a mixture thereof with at least one delivery agent compound and to a subject in need thereof. While "obesity" is generally defined as a body mass index over 30, for purposes of this disclosure, any subject, including those with a body mass index of less than 30, who needs or wishes to reduce body weight is included in the scope of "obese." Subjects who are insulin resistant, glucose intolerant, or have any form of diabetes mellitus (e.g., type 1, 2 or gestational diabetes) can benefit from this method.

In other aspects, the invention features methods of reducing food intake, treating diabetes mellitus, and improving lipid profile (including reducing LDL cholesterol and triglyceride levels and/or changing HDL cholesterol levels)

comprising administering to a subject in need thereof a therapeutically effective amount of a PYY analog, a PYY agonist analog, or a mixture thereof with at least one delivery agent compound. In some embodiments, the methods of the invention are used to treat conditions or disorders which can be alleviated by reducing nutrient availability in a subject in need thereof, comprising administering to said subject in need thereof a therapeutically effective amount of a PYY analog, a PYY agonist analog, or a mixture thereof with at least one delivery agent compound. Such conditions and disorders include, but are not limited to, hypertension, dyslipidemia, cardiovascular disease, eating disorders, insulin-resistance, obesity, and diabetes mellitus of any kind.

Suitable PYY agonist analogs may be derived or based upon the amino acid sequence of PYY agonists that have a potency in one of the assays described in WO 02/47712 and U.S. patent Publication No. 2002/0141985 (which is herein incorporated by reference and discloses the activity of food intake, gastric emptying, pancreatic secretion, or weight reduction assays) which is greater than the potency of NPY in that same assay. A PYY analog and/or a PYY agonist analog with the delivery agent compound may be administered separately or together with one or more other compounds and compositions that exhibit a long term or short-term action to reduce nutrient availability, including, but not limited to other compounds and compositions that comprise an amylin or amylin agonist, a cholecystokinin (CCK) or CCK agonist, a leptin (OB protein) or leptin agonist, an exendin or exendin agonist, or a GLP-1 or GLP-1 agonist as described in U.S. Patent Publication 20050009748. Suitable amylin agonists include, for example, (25,28,29Pro-)-human amylin (also known as "pramlintide", and described in U.S. Pat. Nos. 5,686,511 and 5,998,367), calcitonin (e.g., salmon calcitonin), including those described in U.S. Pat. No. 5,739,106, which is hereby incorporated by reference. The CCK used is preferably CCK octapeptide (CCK-8). Leptin is discussed in, for example, Pelleymounter, C. et al., Science 269: 540-543 (1995), Halaas, G. et al., Science 269: 543-6 (1995) and Campfield, S. et al., Science 269: 546-549 (1995). Suitable CCK agonist includes those described in U.S. Pat. No. 5,739,106, which is hereby incorporated by reference. Suitable exendins include exendin-3 and exendin-4, and exendin agonist compounds include, for example, those described in PCT Publications WO 99/07404, WO 99/25727, and WO 99/25728, all of which are hereby incorporated by reference. According to one embodiment, the composition of the present invention includes at least one delivery agent compound, PYY, a PYY agonist, or a mixture thereof, at least one amylin agonist, and a CCK agonist. Suitable combinations of amylin agonist and CCK agonist include, but are not limited to, those described in U.S. Pat. No. 5,739,106, which is hereby incorporated by reference.

In some embodiments, the pharmaceutical compositions comprises an analog of the polypeptides disclosed below, wherein the analog amino acid sequence is based upon fragments, polypeptides, and functional deriviatives with 70%, 75%, 85%, 90%, 95%, 98%, or 99% sequence homology to the following polypeptides disclosed below:

Adrenocorticotropic hormone (ACTH) peptides including, but not limited to, ACTH, human; ACTH 1-10; ACTH 1-13, human; ACTH 1-16, human; ACTH 1-17; ACTH 1-24, human; ACTH 4-10; ACTH 4-11; ACTH 6-24; ACTH 7-38, human; ACTH 18-39, human; ACTH, rat; ACTH 12-39, rat; beta-cell tropin (ACTH 22-39); biotinyl-ACTH 1-24, human; biotinyl-ACTH 7-38, human; corticostatin, human; corticostatin, rabbit; {Met(02)$^4$, DLys$^8$, Phe$^9$} ACTH 4-9, human; {Met(O)$^4$,DLys$^8$, Phe$^9$} ACTH 4-9, human; N-acetyl, ACTH 1-17, human; and ebiratide.

Adrenomedullin peptides including, but not limited to, adrenomedullin, adrenomedullin 1-52, human; adrenomedullin 1-12, human; adrenomedullin 13-52, human; adrenomedullin 22-52, human; pro-adrenomedullin 45-92, human; pro-adrenomedullin 153-185, human; adrenomedullin 1-52, porcine; pro-adrenomedullin (N-20), porcine; adrenomedullin 1-50, rat; adrenomedullin 11-50, rat; and proAM-N20 (proadrenomedullin N-terminal 20 peptide), rat.

Allatostatin peptides including, but not limited to, allatostatin I; allatostatin II; allatostatin III; and allatostatin IV.

Amylin peptides including, but not limited to, acetyl-amylin 8-37, human; acetylated amylin 8-37, rat; AC187 amylin antagonist; AC253 amylin antagonist; AC625 amylin antagonist; amylin 8-37, human; amylin (IAPP), cat; amylin (insulinoma or islet amyloid polypeptide(IAPP)); amylin amide, human; amylin 1-13 (diabetes-associated peptide 1-13), human; amylin 20-29 (IAPP 20-29), human; AC625 amylin antagonist; amylin 8-37, human; amylin (IAPP), cat; amylin, rat; amylin 8-37, rat; biotinyl-amylin, rat; and biotinyl-amylin amide, human.

Amyloid beta-protein fragment peptides including, but not limited to, Alzheimer's disease beta-protein 12-28 (SP17); amyloid beta-protein 25-35; amyloid beta/A4-protein precursor 328-332; amyloid beta/A4 protein precursor (APP) 319-335; amyloid beta-protein 1-43; amyloid beta-protein 1-42; amyloid beta-protein 1-40; amyloid beta-protein 10-20; amyloid beta-protein 22-35; Alzheimer's disease beta-protein (SP28); beta-amyloid peptide 1-42, rat; beta-amyloid peptide 1-40, rat; beta-amyloid 1-11; beta-amyloid 31-35; beta-amyloid 32-35; beta-amyloid 35-25; beta-amyloid/A4 protein precursor 96-110; beta-amyloid precursor protein 657-676; beta-amyloid 1-38; (Gln$^{11}$)-Alzheimer's disease beta-protein; (Gln$^{11}$)-beta-amyloid 1-40; (Gln$^{22}$)-beta-amyloid 6-40; non-A beta component of Alzheimer's disease amyloid (NAC); P3, (A beta 17-40) Alzheimer's disease amyloid .beta.-peptide; and SAP (serum amyloid P component) 194-204.

Angiotensin peptides including, but not limited to, A-779; Ala-Pro-Gly-angiotensin II; (Ile$^3$,Val$^5$)-angiotensin II; angiotensin III antipeptide; angiogenin fragment 108-122; angiogenin fragment 108-123; angiotensin I converting enzyme inhibitor; angiotensin I, human; angiotensin I converting enzyme substrate; angiotensin I 1-7, human; angiopeptin; angiotensin II, human; angiotensin II antipeptide; angiotensin II 1-4, human; angiotensin II 3-8, human; angiotensin II 4-8, human; angiotensin II 5-8, human; angiotensin III ({Des-Asp$^1$}-angiotensin II), human; angiotensin III inhibitor ({Ile$^7$}-angiotensin III); angiotensin-converting enzyme inhibitor (Neothunnus macropterus); {Asn$^1$, Val$^5$}-angiotensin I, goosefish; {Asn$^1$, Val$^5$, Asn$^9$}-angiotensin I, salmon; {Asn$^1$, Val$^5$, Gly$^9$}-angiotensin I, eel; {Asn$^1$, Val$^5$}-angiotensin I 1-7, eel, goosefish, salmon; {Asn$^1$,Val$^5$}-angiotensin II; biotinyl-angiotensin I, human; biotinyl-angiotensin II, human; biotinyl-Ala-Ala-Ala-angiotensin II; {Des-Asp$^1$}-angiotensin I, human; {p-aminophenylalanine$^6$}-angiotensin II; renin substrate (angiotensinogen 1-13), human; preangiotensinogen 1-14 (renin substrate tetradecapeptide), human; renin substrate tetradecapeptide (angiotensinogen 1-14), porcine; {Sar$^1$}-angiotensin II, {Sar$^1$}-angiotensin II 1-7 amide; {Sar$^1$, Ala$^8$}-angiotensin II; {Sar$^1$, Ile$^8$}-angiotensin II; {Sar$^1$, Thr$^8$}-angiotensin II; {Sar$^1$, Tyr (Me)$^4$}-angiotensin II (Sarmesin); {Sar$^1$, Val$^5$, Ala$^8$}-angiotensin II; {Sar$^1$, Ile$^7$}-angiotensin III; synthetic tetradecapeptide renin substrate (No. 2); {Val$^4$}-angiotensin III;

{Val⁵}-angiotensin II; {Val⁵}-angiotensin I, human; {Val⁵}-angiotensin I; {Val⁵, Asn⁹}-angiotensin I, bullfrog; and {Val⁵, Ser⁹}-angiotensin I, fowl.

Antibiotic peptides including, but not limited to, Ac-SQNY; bactenecin, bovine; CAP 37 (20-44); car-bormethoxycarbonyl-DPro-DPhe-OBzl; CD36 peptide P 139-155; CD36 peptide P 93-110; cecropin A-melittin hybrid peptide {CA(1-7)M(2-9)NH₂}; cecropin B, free acid; CYS(Bzl)84 CD fragment 81-92; defensin (human) HNP-2; dermaseptin; immunostimulating peptide, human; lactoferricin, bovine (BLFC); and magainin spacer.

Antigenic polypeptides, which can elicit an enhanced immune response, enhance an immune response and or cause an immunizingly effective response to diseases and/or disease causing agents including, but not limited to, adenoviruses; anthrax; Bordetella pertussus; botulism; bovine rhinotracheitis; Branhamella catarrhalis; canine hepatitis; canine distemper; Chlamydiae; cholera; coccidiomycosis; cowpox; cytomegalovirus; Dengue fever; dengue toxoplasmosis; diphtheria; encephalitis; enterotoxigenic *E. coli*; Epstein Barr virus; equine encephalitis; equine infectious anemia; equine influenza; equine pneumonia; equine rhinovirus; *Escherichia coli*; feline leukemia; flavivirus; globulin; haemophilus influenza type b; Haemophilus influenzae; Haemophilus pertussis; Helicobacter pylori; hemophilus; hepatitis; hepatitis A; hepatitis B; Hepatitis C; herpes viruses; HIV; HIV-1 viruses; HIV-2 viruses; HTLV; influenza; Japanese encephalitis; Klebsiellae species; Legionella pneumophila; leishmania; leprosy; lyme disease; malaria immunogen; measles; meningitis; meningococcal; Meningococcal polysaccharide group A; Meningococcal polysaccharide group C; mumps; mumps virus; mycobacteria; Mycobacterium tuberculosis; Neisseria; Neisseria gonorrhea; Neisseria meningitidis; ovine blue tongue; ovine encephalitis; papilloma; parainfluenza; paramyxoviruses; Pertussis; plague; pneumococcus; Pneumocystis carinii; pneumonia; poiiovirus; proteus species; Pseudomonas aeruginosa; rabies; respiratory syncytial virus; rotavirus; rubella; salmonellae; schistosomiasis; shigellae; simian immunodeficiency virus; smallpox; Staphylococcus aureus; Staphylococcus species; Streptococcus pneumoniae; Streptococcus pyogenes; Streptococcus species; swine influenza; tetanus; Treponema pallidum; typhoid; vaccinia; varicella-zoster virus; and vibrio cholerae.

Anti-microbial peptides including, but not limited to, buforin I; buforin II; cecropin A; cecropin B; cecropin P1, porcine; gaegurin 2 (Rana rugosa); gaegurin 5 (Rana rugosa); indolicidin; protegrin-(PG)-I; magainin 1; and magainin 2; and T-22 {Tyr⁵,¹², Lys⁷}-poly-phemusin II peptide.

Apoptosis related peptides including, but not limited to, Alzheimer's disease beta-protein (SP28); calpain inhibitor peptide; capsase-1 inhibitor V; capsase-3, substrate IV; caspase-1 inhibitor I, cell-permeable; caspase-1 inhibitor VI; caspase-3 substrate III, fluorogenic; caspase-1 substrate V, fluorogenic; caspase-3 inhibitor I, cell-permeable; caspase-6 ICE inhibitor III; {Des-Ac, biotin}-ICE inhibitor III; IL-1B converting enzyme (ICE) inhibitor II; IL-1 B converting enzyme (ICE) substrate IV; MDL 28170; and MG-132.

Atrial natriuretic peptides including, but not limited to, alpha-ANP (alpha-chANP), chicken; anantin; ANP 1-11, rat; ANP 8-30, frog; ANP 11-30, frog; ANP-21 (fANP-21), frog; ANP-24 (fANP-24), frog; ANP-30, frog; ANP fragment 5-28, human, canine; ANP-7-23, human; ANP fragment 7-28, human, canine; alpha-atrial natriuretic polypeptide 1-28, human, canine; A71915, rat; atrial natriuretic factor 8-33, rat; atrial natriuretic polypeptide 3-28, human; atrial natriuretic polypeptide 4-28, human, canine; atrial natriuretic polypeptide 5-27; human; atrial natriuretic aeptide (ANP), eel; atriopeptin I, rat, rabbit, mouse; atriopeptin II, rat, rabbit, mouse; atriopeptin III, rat, rabbit, mouse; atrial natriuretic factor (rANF), rat, auriculin A (rat ANF 126-149); auriculin B (rat ANF 126-150); beta-ANP (1-28, dimer, antiparallel); beta-rANF 17-48; biotinyl-alpha-ANP 1-28, human, canine; biotinyl-atrial natriuretic factor (biotinyl-rANF), rat; cardiodilatin 1-16, human; C-ANF 4-23, rat; Des-{Cys¹⁰⁵, Cys¹²¹}-atrial natriuretic factor 104-126, rat; {Met(O)¹²} ANP 1-28, human; {Mpr⁷,DAla⁹}ANP 7-28, amide, rat; prepro-ANF 104-116, human; prepro-ANF 26-55 (proANF 1-30), human; prepro-ANF 56-92 (proANF 31-67), human; prepro-ANF 104-123, human; {Tyr⁰}-atriopeptin I, rat, rabbit, mouse; {Tyr⁰}-atriopeptin II, rat, rabbit, mouse; {Tyr⁰-prepro ANF 104-123, human; urodilatin (CDD/ANP 95-126); ventricular natriuretic peptide (VNP), eel; and ventricular natriuretic peptide (VNP), rainbow trout.

Bag cell peptides including, but not limited to, alpha bag cell peptide; alpha-bag cell peptide 1-9; alpha-bag cell peptide 1-8; alpba-bag cell peptide 1-7; beta-bag cell factor, and gamma-bag cell factor.

Bombesin peptides including, but not limited to, alpha-sl casein 101-123 (bovine milk); biotinyl-bombesin; bombesin 8-14; bombesin; {Leu¹³-psi (CH₂NH)Leu¹⁴}-bombesin; {D-Phe⁶, Des-Met¹⁴}-bombesin 6-14 ethylamide; {DPhe¹²} bombesin; {DPhe¹²,Leu¹⁴}-bombesin; {Tyr⁴}-bombesin; and {Tyr⁴,DPhe¹²}-bombesin.

Bone GLA peptides (BGP) including, but not limited to, bone GLA protein; bone GLA protein 45-49; {Glu¹⁷, Gla²¹,²⁴}-osteocalcin 1-49, human; myclopeptide-2 (MP-2); osteocalcin 1-49 human; osteocalcin 37-49, human; and {Tyr³⁸, Phe⁴²,⁴⁶} bone GLA protein 38-49, human.

Bradykinin peptides including, but not limited to, {Ala²,⁶, des-Pro³}-bradykinin; bradykinin; bradykinin (Bowfin. Gar); bradykinin potentiating peptide; bradykinin 1-3; bradykinin 1-5; bradykinin 1-6; bradykinin 1-7; bradykinin 2-7; bradykinin 2-9; {DPhe⁷} bradykinin; {Des-Arg⁹}-bradykinin; {Des-Arg¹⁰}-Lys-bradykinin ({Des-Arg¹⁰}-kallidin); {D-N-Me-Phe⁷}-bradykinin; {Des-Arg⁹, Leu⁸}-bradykinin; Lys-bradykinin (kallidin); Lys-(Des-Arg⁹, Leu⁸}-bradykinin ({Des-Arg¹⁰, Leu⁹}-kallidin); {Lys⁰-Hyp³}-bradykinin; ovokinin; {Lys⁰, Ala³}-bradykinin; Met-Lys-bradykinin; peptide K12 bradykinin potentiating peptide; {(pCl)Phe⁵,⁸}-bradykinin; T-kinin (Ile-Ser-bradykinin); {Thi.⁵,⁸, D-Phe⁷}-bradykinin; {Tyr⁰}-bradykinin; {Tyr⁵}-bradykinin; {Tyr⁸}-bradykinin; and kallikrein.

Brain natriuretic peptides (BNP) including, but not limited to, BNP 32, canine; BNP-like Peptide, eel; BNP-32, human; BNP-45, mouse; BNP-26, porcine; BNP-32, porcine; biotinyl-BNP-32, porcine; BNP-32, rat; biotinyl-BNP-32, rat; BNP45 (BNP 51-95, 5K cardiac natriuretic peptide), rat; and {Tyr⁰}-BNP 1-32, human.

C-peptides including, but not limited to, C-peptide; and {Tyr⁰}-C-peptide, human.

C-type natriuretic peptides (CNP) including, but not limited to, C-type natriuretic peptide, chicken; C-type natriuretic peptide-22 (CNP-22), porcine, rat, human; C-type natriuretic peptide-53 (CNP-53), human; C-type natriuretic peptide-53 (CNP-53), porcine, rat; C-type natriuretic peptide-53 (porcine, rat) 1-29 (CNP-531-29); prepro-CNP 1-27, rat; prepro-CNP 30-50, porcine, rat; vasonatrin peptide (VNP); and {Tyr⁰}-C-type natriuretic peptide-22 ({Tyr⁰}-CNP-22).

Calcitonin peptides including, but not limited to, biotinyl-calcitonin, human; biotinyl-calcitonin, rat; biotinyl-calcitonin, salmon; calcitonin, chicken; calcitonin, eel; calcitonin, human; calcitonin, porcine; calcitonin, rat; calcitonin, salmon; calcitonin 1-7, human; calcitonin 8-32, salmon; katacalcin (PDN-21) (C-procalcitonin); and N-proCT (amino-terminal procalcitonin cleavage peptide), human.

Calcitonin gene related peptides (CGRP) including, but not limited to, acetyl-alpha-CGRP 19-37, human; alpha-CGRP 19-37, human; alpha-CGRP 23-37, human; biotinyl-CGRP, human; biotinyl-CGRP II, human; biotinyl-CGRP, rat; beta-CGRP, rat; biotinyl-beta-CGRP, rat; CGRP, rat; CGRP, human; calcitonin C-terminal adjacent peptide; CGRP 1-19, human; CGRP 20-37, human; CGRP 8-37, human; CGRP II, human; CGRP, rat; CGRP 8-37, rat; CGRP 29-37, rat; CGRP 30-37, rat; CGRP 31-37, rat; CGRP 32-37, rat; CGRP 33-37, rat; CGRP 31-37, rat; ({Cys(Acm)$^{2,7}$}-CGRP; elcatonin; {Tyr$^0$}-CGRP, human; {Tyr$^0$}-CGRP II, human; {Tyr$^0$}-CGRP 28-37, rat; {Tyr$^0$}-CGRP, rat; and {Tyr$^{22}$}-CGRP 22-37, rat.

CART peptides including, but not limited to, CART, human; CART 55-102, human; CART, rat; and CART 55-102, rat.

Casomorphin peptides including, but not limited to, beta-casomorphin, human; beta-casomorphin 1-3; beta-casomorphin 1-3, amide; beta-casomorphin, bovine; beta-casomorphin 1-4, bovine; beta-casomorphin 1-5, bovine; beta-casomorphin 1-5, amide, bovine; beta-casomorphin 1-6, bovine; {DAla$^2$}-beta-casomorphin 1-3, amide, bovine; {DAla$^2$,Hyp$^4$,Tyr$^5$}-beta-casomorphin 1-5 amide; {DAla$^2$, DPro$^4$,Tyr$^5$}-beta-casomorphin 1-5, amide; {DAla$^2$,Tyr$^5$}-beta-casomorphin 1-5, amide, bovine; {DAla$^{2,4}$,Tyr$^5$}-beta-casomorphin 1-5, amide, bovine; {DAla$^2$, (pCl)Phe$^3$}-beta-casomorphin, amide, bovine; {DAla$^2$}-beta-casomorphin 1-4, amide, bovine; {DAla$^2$}-beta-casomorphin 1-5, bovine; {DAla$^2$}-beta-casomorphin 1-5, amide, bovine; {DAla$^2$, Met$^5$}-beta-casomorphin 1-5, bovine; {DPro$^2$}-beta-casomorphin 1-5, amide, bovine; {DAla$^2$}-beta-casomorphin 1-6, bovine; {DPro$^2$}-beta-casomorphin 1-4, amide; {Des-Tyr$^1$}-beta-casomorphin, bovine; {DAla$^{2,4}$,Tyr$^5$}-beta-casomorphin 1-5, amide, bovine; {DAla$^2$, (pCl)Phe$^3$}-beta-casomorphin, amide, bovine; {DAla$^2$}-beta-casomorphin 1-4, amide, bovine; {DAla$^2$}-beta-casomorphin 1-5, bovine; {DAla$^2$}-beta-casomorphin 1-5, amide, bovine; {DAla$^2$, Met$^5$}-beta-casomorphin 1-5, bovine; {DPro$^2$}-beta-casomorphin 1-5, amide, bovine; {DAla$^2$}-beta-casomorphin 1-6, bovine; {DPro$^2$}-beta-casomorphin 14, amide; {Des-Tyr$^1$}-beta-casomorphin, bovine; and {Val$^3$}-beta-casomorphin 1-4, amide, bovine.

Chemotactic peptides including, but not limited to, defensin 1 (human) HNP-1 (human neutrophil peptide-1); and N-formyl-Met-Leu-Phe.

Cholecystokinin (CCK) peptides including, but not limited to, caerulein; cholecystokinin; cholecystokinin-pancreozymin; CCK-33, human; cholecystokinin octapeptide 14 (non-sulfated) (CCK 26-29, unsulfated); cholecystokinin octapeptide (CCK 26-33); cholecystokinin octapeptide (non-sulfated) (CCK 26-33, unsulfated); cholecystokinin heptapeptide (CCK 27-33); cholecystokinin tetrapeptide (CCK 30-33); CCK-33, porcine; CR 1409, cholecystokinin antagonist; CCK flanking peptide (unsulfated); N-acetyl cholecystokinin, CCK 26-30, sulfated; N-acetyl cholecystokinin, CCK 26-31, sulfated; N-acetyl cholecystokinin, CCK 26-31, non-sulfated; prepro CCK fragment V-9-M; and proglumide.

Colony-stimulating factor peptides including, but not limited to, colony-stimulating factor (CSF); GMCSF; MCSF; and G-CSF.

Corticortropin releasing factor (CRF) peptides including, but not limited to, astressin; alpha-helical CRF 12-41; biotinyl-CRF, ovine; biotinyl-CRF, human, rat; CRF, bovine; CRF, human, rat; CRF, ovine; CRF, porcine; {Cys$^{21}$}-CRF, human, rat; CRF antagonist (alpha-helical CRF 9-41); CRF 6-33, human, rat; {DPro$^5$}-CRF, human, rat; {D-Phe$^{12}$, Nle$^{21,38}$}-CRF 12-41, human, rat; eosinophilotactic peptide; {Met(0)$^{21}$}-CRF, ovine; {Nle$^{21}$,Tyr$^{32}$}-CRF, ovine; prepro CRF 125-151, human; sauvagine, frog; {Tyr$^0$}-CRF, human, rat; {Tyr$^0$}-CRF, ovine; {Tyr$^0$}-CRF 34-41, ovine; {Tyr$^0$}-urocortin; urocortin amide, human; urocortin, rat; urotensin I (Catostomus commersoni); urotensin II; and urotensin II (Rana ridibunda).

Cortistatin peptides including, but not limited to, cortistatin 29; cortistatin 29 (1-13); {Tyr$^0$}-cortistatin 29; pro-cortistatin 28-47; and pro-cortistatin 51-81.

Cytokine peptides including, but not limited to, tumor necrosis factor; and tumor necrosis factor-.beta. (TNF-.beta.).

Dermorphin peptides including, but not limited to, dermorphin and dermorphin analog 1-4.

Dynorphin peptides including, but not limited to, big dynorphin (prodynorphin 209-240), porcine; biotinyl-dynorphin A (biotinyl-prodynorphin 209-225); {DAla$^2$, DArg$^6$}dynorphin A 1-13, porcine; {D-Ala$^2$}-dynorphin A, porcine; {D-Ala$^2$}-dynorphin A amide, porcine; {D-Ala$^2$}-dynorphin A 1-13, amide, porcine; {D-Ala$^2$}-dynorphin A 1-9, porcine; {DArg$^6$}-dynorphin A 1-13, porcine; {DArg$^8$}-dynorphin A 1-13, porcine; {Des-Tyr$^1$}-dynorphin A 1-8; {D-Pro$^{10}$}-dynorphin A 1-11, porcine; dynorphin A amide, porcine; dynorphin A 1-6, porcine; dynorphin A 1-7, porcine; dynorphin A 1-8, porcine; dynorphin A 1-9, porcine; dynorphin A 1-10, porcine; dynorphin A 1-10 amide, porcine; dynorphin A 1-11, porcine; dynorphin A 1-12, porcine; dynorphin A 1-13, porcine; dynorphin A 1-13 amide, porcine; DAKLI (dynorphin A-analogue kappa ligand); DAKLI-biotin ({Arg$^{11,13}$}-dynorphin A (1-13)-Gly-NH(CH$_2$)$_5$NH-biotin); dynorphin A 2-17, porcine; dynorphin 2-17, amide, porcine; dynorphin A 2-12, porcine; dynorphin A 3-17, amide, porcine; dynorphin A 3-8, porcine; dynorphin A 3-13, porcine; dynorphin A 3-17, porcine; dynorphin A 7-17, porcine; dynorphin A 8-17, porcine; dynorphin A 6-17, porcine; dynorphin A 13-17, porcine; dynorphin A (prodynorphin 209-225), porcine; dynorphin B 1-9; {MeTyr$^1$, MeArg$^7$, D-Leu$^8$}-dynorphin 1-8 ethyl amide; {(nMe)Tyr$^1$} dynorphin A 1-13, amide, porcine; {Phe$^7$}-dynorphin A 1-7, porcine; {Phe$^7$}-dynorphin A 1-7, amide, porcine; and prodynorphin 228-256 (dynorphin B 29) (leumorphin), porcine.

Endorphin peptides including, but not limited to, alpha-neo-endorphin, porcine; beta-neoendorphin; Ac-beta-endorphin, camel, bovine, ovine; Ac-beta-endorphin 1-27, camel, bovine, ovine; Ac-beta-endorphin, human; Ac-beta-endorphin 1-26, human; Ac-beta-endorphin 1-27, human; Ac-gamma-endorphin (Ac-beta-lipotropin 61-77); acetyl-alpha-endorphin; alpha-endorphin (beta-lipotropin 61-76); alpha-neo-endorphin analog; alpha-neo-endorphin 1-7; {Arg$^8$}-alpha-neoendorphin 1-8; beta-endorphin (beta-lipotropin 61-91), camel, bovine, ovine; beta-endorphin 1-27, camel, bovine, ovine; beta-endorphin, equine; beta-endorphin (beta-lipotropin 61-91), human; beta-endorphin (1-5)+(16-31), human; beta-endorphin 1-26, human; beta-endorphin 1-27, human; beta-endorphin 6-31, human; beta-endorphin 18-31, human; beta-endorphin, porcine; beta-endorphin, rat; beta-lipotropin 1-10, porcine; beta-lipotropin 60-65; beta-lipotropin 61-64; beta-lipotropin 61-69; beta-lipotropin 88-91; biotinyl-beta-endorphin (biotinyl-bets-lipotropin 61-91); biocytin-beta-endorphin, human; gamma-endorphin (beta-lipotropin 61-77); {DAla$^2$}-alpha-neo-endorphin 1-2, amide; {DAla$^2$}-beta-lipotropin 61-69; {DAla$^2$}-gamma-endorphin; {Des-Tyr$^1$}-beta-endorphin, human; {Des-Tyr$^1$}-gamma-endorphin (beta-lipotropin 62-77); {Leu$^5$}-beta-endorphin, camel, bovine, ovine; {Met$^5$, Lys$^6$}-alpha-neo-endorphin 1-6; {Met$^5$, Lys$^{6,7}$}-alpha-neo-endorphin 1-7; and {Met$^5$, Lys$^6$, Arg$^7$}-alpha-neo-endorphin 1-7.

Endothelin peptides including, but not limited to, endothelin-1 (ET-1); endothelin-1{Biotin-Lys$^9$}; endothelin-1 (1-15), human; endothelin-1 (1-15), amide, human; Ac-endothelin-1 (16-21), human; Ac-{DTrp$^{16}$}-endothelin-1 (16-21), human; {Ala$^{3,11}$}-endothelin-1; {Dpr1, Asp$^{15}$}-endothelin-1; {Ala$^2$}-endothelin-3, human; {Ala$^{18}$}-endothelin-1, human; {Asn$^{18}$}-endothelin-1, human; {Res-701-1}-endothelin B receptor antagonist; Suc-{Glu$^9$, Ala$^{11,15}$}-endothelin-1 (8-21), IRL-1620; endothelin-C-terminal hexapeptide; {D-Val$^{22}$}-big endothelin-1 (16-38), human; endothelin-2 (ET-2), human, canine; endothelin-3 (ET-3), human, rat, porcine, rabbit; biotinyl-endothelin-3 (biotinyl-ET-3); prepro-endothelin-1 (94-109), porcine; BQ-518; BQ-610; BQ-788; endothelium-dependent relaxation antagonist; FR139317; IRL-1038; JKC-30 1; JKC-302; PD-145065; PD-142893; sarafotoxin S6a (atractaspis engaddensis); sarafotoxin S6b (atractaspis engaddensis); sarafotoxin S6c (atractaspis engaddensis); {Lys$^4$}-sarafotoxin S6c; sarafotoxin S6d; big endothelin-1, human; biotinyl-big endothelin-1, human; big endothelin-1 (1-39), porcine; big endothelin-3 (22-41), amide, human; big endothelin-1 (22-39), rat; big endothelin-1 (1-39), bovine; big endothelin-1 (22-39), bovine; big endothelin-1 (19-38), human; big endothelin-1 (22-38), human; big endothelin-2, human; big endothelin-2 (22-37), human; big endothelin-3, human; big endothelin-1, porcine; big endothelin-1 (22-39) (prepro-endothelin-1 (74-91)); big endothelin-1, rat; big endothelin-2 (1-38), human; big endothelin-2 (22-38), human; big endothelin-3, rat; biotinyl-big endothelin-1, human; and {Tyr$^{123}$}-prepro-endothelin (110-130), amide, human.

ETa receptor antagonist peptides including, but not limited to, {BQ-123}; {BE18257B}; {BE-18257A}/{W-7338A}; {BQ-485}; FR139317; PD-151242; and TTA-386.

ETb receptor antagonist peptides including, but not limited to, {BQ-3020}; {RES-701-3}; and {IRL-1720}

Enkephalin peptides including, but not limited to, adrenorphin, free acid; amidorphin (proenkephalin A (104-129)-NII2), bovine; BAM-12P (bovine adrenal medulla enkephalin; {D-Ala$^2$, D-Leu$^5$}-enkephalin; {D-Ala$^2$, D-Met$^5$}-enkephalin; {DAla$^2$}-Leu-enkephalin, amide; {DAla$^2$, Leu$^5$, Arg$^6$}-enkephalin; {Des-Tyr$^1$,DPen$^{2,5}$}-enkephalin; {Des-Tyr$^1$,DPen$^2$,Pen$^5$}-enkephalin; {Des-Tyr$^1$}-Leu-enkephalin; {D-Pen$^{2,5}$}-enkephalin; {DPen$^2$, Pen$^5$}-enkephalin; enkephalinase substrate; {D-Pen$^2$, pCI-Phe$^4$, D-Pen$^5$}-enkephalin; Leu-enkephalin; Leu-enkephalin, amide; biotinyl-Leu-enkephalin; {D-Ala$^2$}-Leu-enkephalin; {D-Ser$^2$}-Leu-enkephalin-Thr (delta-receptor peptide) (DS-LET); {D-Thr$^2$}-Leu-enkephalin-Thr (DTLET); {Lys$^6$}-Leu-enkephalin; {Met$^5$,Arg$^6$}-enkephalin; {Met$^5$,Arg$^6$-enkephalin-Arg; {Met$^5$,Arg$^6$,Phe$^7$}-enkephalin, amide; Met-enkephalin; biotinyl-Met-enkephalin; {D-Ala$^2$}-Met-enkephalin; {D-Ala$^2$}-Met-enkephalin, amide; Met-enkephalin-Arg-Phe; Met-enkephalin, amide; {Ala$^2$}-Met-enkephalin, amide; {DMet$^2$,Pro$^5$}-enkephalin, amide; {DTrp$^2$}-Met-enkephalin, amide, metorphinamide (adrenorphin); peptide B, bovine; 3200-Dalton adrenal peptide E, bovine; peptide F, bovine; preproenkephalin B 186-204, human; spinorphin, bovine; and thiorphan (D,L,3-mercapto-2-benzylpropanoyl-glycine).

Fibronectin peptides including, but not limited to platelet factor-4 (58-70), human; echistatin (*Echis carinatus*); E, P, L selectin conserved region; fibronectin analog; fibronectin-binding protein; fibrinopeptide A, human; {Tyr$^0$}-fibrinopeptide A, human; fibrinopeptide B, human; {Glu$^1$}-fibrinopeptide B, human; {Tyr$^{15}$}-fibrinopeptide B, human; fibrinogen beta-chain fragment of 24-42; fibrinogen binding inhibitor peptide; fibronectin related peptide (collagen binding fragment); fibrinolysis inhibiting factor; FN-C/H-1 (fibronectin heparin-binding fragment); FN-C/H-V (fibronectin heparin-binding fragment); heparin-binding peptide; laminin penta peptide, amide; Leu-Asp-Val-NH$_2$ (LDV-NH$_2$), human, bovine, rat, chicken; necrofibrin, human; necrofibrin, rat; and platelet membrane glycoprotein IIB peptide 296-306.

Galanin peptides including, but not limited to, galanin, human; galanin 1-19, human; preprogalanin 1-30, human; preprogalanin 65-88, human; preprogalanin 89-123, human; galanin, porcine; galanin 1-16, porcine, rat; galanin, rat; biotinyl-galanin, rat; preprogalanin 28-67, rat; galanin 1-13-bradykinin 2-9, amide; M40, galanin 1-13-Pro-Pro-(Ala-Leu) 2-Ala-amide; C7, galanin 1-13-spantide-amide; GMAP 1-41, amide; GMAP 16-41, amide; GMAP 25-41, amide; galantide; and entero-kassinin.

Gastrin peptides including, but not limited to, gastrin, chicken; gastric inhibitory peptide (GIP), human; gastrin I, human; biotinyl-gastrin I, human; big gastrin-1, human; gastrin releasing peptide, human; gastrin releasing peptide 1-16, human; gastric inhibitory polypeptide (GIP), porcine; gastrin releasing peptide, porcine; biotinyl-gastrin releasing peptide, porcine; gastrin releasing peptide 14-27, porcine, human; little gastrin, rat; pentagastrin; gastric inhibitory peptide 1-30, porcine; gastric inhibitory peptide 1-30, amide, porcine; {Tyr$^0$-gastric inhibitory peptide 23-42, human; and gastric inhibitory peptide, rat.

Glucagon peptides including, but not limited to, {Des-His-Glu$^9$}-glucagon, exendin-4, glucagon, human; biotinyl-glucagon, human; glucagon 19-29, human; glucagon 22-29, human; {Des-His'-Glu$^9$}-glucagon, amide; glucagon-like peptide 1, amide; glucagon-like peptide 1, human; glucagon-like peptide 1 (7-36); glucagon-like peptide 2, rat; biotinyl-glucagon-like peptide-1 (7-36) (biofinyl-preproglucagon 78-107, amide); glucagon-like peptide 2, human; intervening peptide-2; oxyntomodulin/glucagon 37; and valosin (peptide VQY), porcine.

Gn-RH associated peptides (GAP) including, but not limited to, Gn-RH associated peptide 25-53, human; Gn-RH associated peptide 1-24, human; Gn-RH associated peptide 1-13, human; Gn-RH associated peptide 1-13, rat; gonadotropin releasing peptide, follicular, human; {Tyr$^0$}-GAP ({Tyr$^0$}-Gn-RH Precursor Peptide 14-69), human; and proopiomelanocortin (POMC) precursor 27-52, porcine.

Growth factor peptides including, but not limited to, cell growth factors; epidermal growth factors; tumor growth factor; alpha-TGF; beta-TF; alpha-TGF 34-43, rat; EGF, human; acidic fibroblast growth factor; basic fibroblast growth factor; basic fibroblast growth factor 13-18; basic fibroblast growth factor 120-125; brain derived acidic fibroblast growth factor 1-11; brain derived basic fibroblast growth factor 1-24; brain derived acidic fibroblast growth factor 102-111; {Cys(Acm$^{20,31}$)}-epidermal growth factor 20-31; epidermal growth factor receptor peptide 985-996; insulin-like growth factor (IGF)-I, chicken; IGF-I, rat; IGF-I, human; Des (1-3) IGF-I, human; R3 IGF-I, human; R3 IGF-I, human; long R3 IGF-I, human; adjuvant peptide analog; anorexigenic peptide; Des (1-6) IGF-II, human; R6 IGF-II, human; IGF-I analogue; IGF 1 (24-41); IGF 1

(57-70); IGF I (30-41); IGF II; IGF II (33-40); {Tyr$^0$}-IGF II (33-40); liver cell growth factor; midkine; midkine 60-121, human; N-acetyl, alpha-TGF 34-43, methyl ester, rat; nerve growth factor (NGF), mouse; platelet-derived growth factor; platelet-derived growth factor antagonist; transforming growth factor-alpha, human; and transforming growth factor-I, rat.

Growth hormone peptides including, but not limited to, growth hormone (hGH), human; growth hormone 1-43, human; growth hormone 6-13, human; growth hormone releasing factor, human; growth hormone releasing factor, bovine; growth hormone releasing factor, porcine; growth hormone releasing factor 1-29, amide, rat; growth hormone pro-releasing factor, human; biotinyl-growth hormone releasing factor, human; growth hormone releasing factor 1-29, amide, human; {D-Ala$^2$}-growth hormone releasing factor 1-29, amide, human; {N-Ac-Tyr$^1$, D-Arg$^2$}-GRF 1-29, amide; {His$^1$, Nle$^{27}$}-growth hormone releasing factor 1-32, amide; growth hormone releasing factor 1-37, human; growth hormone releasing factor 140, human; growth hormone releasing factor 1-40, amide, human; growth hormone releasing factor 30-44, amide, human; growth hormone releasing factor, mouse; growth hormone releasing factor, ovine; growth hormone releasing factor, rat; biotinyl-growth hormone releasing factor, rat; GHRP-6 ({His$^1$, Lys$^6$}-GHRP); hexarelin (growth hormone releasing hexapeptide); and {D-Lys$^3$}-GHRP-6.

GTP-binding protein fragment peptides including, but not limited to, {Arg$^8$}-GTP-binding protein fragment, Gs alpha; GTP-binding protein fragment, G beta; GTP-binding protein fragment, GAlpha; GTP-binding protein fragment, Go Alpha; GTP-binding protein fragment, Gs Alpha; and GTP-binding protein fragment, G Alpha i2.

Guanylin peptides including, but not limited to, guanylin, human; guanylin, rat; and uroguanylin.

Inhibin peptides including, but not limited to, inhibin, bovine; inhibin, alpha-subunit 1-32, human; {Tyr$^0$}-inhibin, alpha-subunit 1-32, human; seminal plasma inhibin-like peptide, human; {Tyr$^0$}-seminal plasma inhibin-like peptide, human; inhibin, alpha-subunit 1-32, porcine; and {Tyr$^0$}-inhibin, alpha-subunit 1-32, porcine.

Insulin peptides including, but not limited to, insulin, human; insulin, porcine; IGF-I, human; insulin-like growth factor II (69-84); pro-insulin-like growth factor 11 (68-102), human; pro-insulin-like growth factor II (105-128), human; {Asp$^{B28}$}-insulin, human; {Lys$^{B28}$}-insulin, human; {Leu$^{B28}$}-insulin, human; {Val$^{B28}$}-insulin, human; {Ala$^{B28}$}-insulin, human; {Asp$^{B28}$, Pro$^{B29}$}-insulin, human; {Lys$^{B28}$, Pro$^{B29}$}-insulin, human; {Leu$^{B28}$ Pro$^{B29}$}-insulin, human; {Val$^{B28}$, Pro$^{B29}$}-insulin, human; {Ala$^{B28}$, Pro$^{B29}$}-insulin, human; {Gly$^{A21}$}-insulin human; {Gly$^{A21}$ Gln$^{B30}$}-insulin, human; {Ala$^{A21}$}-insulin, human; {Ala$^{A21}$ Gln$^{B30}$} insulin, human; {Gln$^{B30}$}-insulin, human; {Gln$^{B30}$}-insulin, human; {Gly$^{A21}$ Glu$^{B30}$}-insulin, human; {Gly$^{A21}$ Gln$^{B3}$ Glu$^{B30}$}-insulin, human; {Gln$^{B3}$ Glu$^{B30}$}-insulin, human; B22-B30 insulin, human; B23-B30 insulin, human; B25-B30 insulin, human; B26-B30 insulin, human; B27-B30 insulin, human; B29-B30 insulin, human; the A chain of human insulin, and the B chain of human insulin.

Interleukin peptides including, but not limited to, interleukin-1 beta 165-181, rat; and interleukin-8 (IL-8, CINC/gro), rat.

Lamimin peptides including, but not limited to, laminin; alpha1 (I)-CB3 435-438, rat; and laminin binding inhibitor.

Leptin peptides including, but not limited to, leptin 93-105, human; leptin 22-56, rat; Tyr-leptin 26-39, human; and leptin 116-130, amide, mouse.

Leucokinin peptides including, but not limited to, leucomyosuppressin (LMS); leucopyrokinin (LPK); leucokinin I; leucokinin II; leucokinin III; leucokinin IV; leucokinin VI; leucokinin VII; and leucokinin VIII.

Luteinizing hormone-releasing hormone peptides including, but not limited to, antide; Gn-RH II, chicken; luteinizing hormone-releasing hormone (LH-RH) (GnRH); biotinyl-LH-RH; cetrorelix (D-20761); {D-Ala$^6$}-LH-RH; {Gln$^8$}-LH-RH (Chicken LH-RH); {DLeu$^6$, Val$^7$} LH-RH 1-9, ethyl amide; {D-Lys$^6$}-LH-RH; {D-Phe$^2$, Pro$^3$, D-Phe$^6$}-LH-RH; {DPhe$^2$, DAla$^6$} LH-RH; {Des-Gly$^{10}$}-LH-RH, ethyl amide; {D-Ala$^6$, Des-Gly$^{10}$}-LH-RH, ethyl amide; {DTrp$^6$}-LH-RH, ethyl amide; {D-Trp$^6$, Des-Gly$^{10}$}-LH-RH, ethyl amide (Deslorelin); {DSer(But)$_6$, Des-Gly$^{10}$}-LH-RH, ethyl amide; ethyl amide; leuprolide; LH-RH 4-10; LH-RH 7-10; LH-RH, free acid; LH-RH, lanprey; LH-RH, salmon; {Lys$^8$}-LH-RH; {Trp$^7$,Leu$^8$} LH-RH, free acid; and {(t-Bu)DSer$^6$, (Aza)Gly$^{10}$}-LH-RH.

Mastoparan peptides including, but not limited to, mastoparan; mas7; mas8; mas17; and mastoparan X.

Mast cell degranulating peptides including, but not limited to, mast cell degranulating peptide HR-1; and mast cell degranulating peptide HR-2.

Melanocyte stimulating hormone (MSH) peptides including, but not limited to, {Ac-Cys$^4$,DPhe$^7$, Cys$^{10}$} alpha-MSH 4-13, amide; alpha-melanocyte stimulating hormone; alpha-MSH, free acid; beta-MSH, porcine; biotinyl-alpha-melanocyte stimulating hormone; biotinyl-{Nle$^4$, D-Phe$^7$} alpha-melanocyte stimulating hormone; {Des-Acetyl}-alpha-MSH; {DPhe$^7$}-alpha-MSH, amide; gamma-1-MSH, amide; {Lys$^0$}-gamma-1-MSH, amide; MSH release inhibiting factor, amide; {Nle$^4$}-alpha-MSH, amide; {Nle$^4$, D-Phe$^7$}-alpha-MSH; N-Acetyl, {Nle$^4$,DPhe$^7$} alpha-MSH 4-10, amide; beta-MSH, human; and gamma-MSH.

Morphiceptin peptides including, but not limited to, morphiceptin (beta-casomorphin 14 amide); {D-Pro$^4$}-morphiceptin; and {N-MePhe$^3$,D-Pro$^4$}-morphiceptin.

Motilin peptides including, but not limited to, motilin, canine; motilin, porcine; biotinyl-motilin, porcine; and {Leu$^{13}$}-motilin, porcine.

Neuro-peptides including, but not limited to, Ac-Asp-Glu; achatina cardio-excitatory peptide-1 (ACEP-1) (Achatina fulica); adipokinetic hormone (AKH) (Locust); adipokinetic hormone (*Heliothis zea* and *Manduca sexta*); alytesin; Tabanus atratus adipokinetic hormone (Taa-AKH); adipokinetic hormone II (*Locusta migratoria*); adipokinetic hormone II (Schistocera gregaria); adipokinetic hormone III (AKH-3); adipokinetic hormone G (AKH-G) (Gryllus bimaculatus); allatotropin (AT) (Manduca sexta); allatotropin 6-13 (Manduca sexta); APGW amide (Lymnaea stagnalis); buccalin; cerebellin; {Des-Ser$^1$}-cerebellin; corazonin (American Cockroach Periplaneta americana); crustacean cardioactive peptide (CCAP); crustacean erythrophore; DF2 (*Procambarus clarkii*); diazepam-binding inhibitor fragment, human; diazepam binding inhibitor fragment (ODN); eledoisin related peptide; FMRF amide (molluscan cardio-excitatory neuropeptide); Gly-Pro-Glu (GPE), human; granuliberin R; head activator neuropeptide; {His$^7$}-corazonin; stick insect hypertrehalosaemic factor II; Tabanus atratus hypotrehalosemic hormone (Taa-HoTH); isoguvacine hydrochloride; bicuculline methiodide; piperidine-4-sulphonic acid; joining peptide of proopiomelanocortin (POMC), bovine; joining peptide, rat; KSAYMRF amide (*P. redivivus*); kassinin; kinetensin; levitide; litorin; LUQ 81-91 (*Aplysia californica*); LUQ 83-91 (*Aplysia californica*); myoactive peptide I (Periplanetin CC-1) (Neuro-homone D); myoactive peptide II (Periplanetin CC-2); myomodulin;

neuron specific peptide; neuron specific enolase 404-443, rat; neuropeptide FF; neuropeptide K, porcine; NEI (prepro-MCH 131-143) neuropeptide, rat; NGE (prepro-MCH 110-128) neuropeptide, rat; NFI (*Procambarus clarkii*); PBAN-1 (*Bombyx mori*); Hez-PBAN (*Heliothis zea*); SCPB (cardio-active peptide from aplysia); secretoneurin, rat; uperolein; urechistachykinin I; urechistachykinin II; xenopsin-related peptide I; xenopsin-related peptide II; pedal peptide (Pep), aplysia; peptide F1, lobster, phyllomedusin; polistes mastoparan; proctolin; ranatensin; Ro I (Lubber Grasshopper, Romalea microptera); Ro II (Lubber Grasshopper, Romalea microptera); SALMF amide 1 (S1); SALMF amide 2 (S2); and SCPA.

Neuropeptide Y (NPY) peptides including, but not limited to, $\{Leu^{31}, Pro^{34}\}$ neuropeptide Y, human; neuropeptide F (*Moniezia expansa*); B1BP3226 NPY antagonist; Bis (31/31') $\{\{Cys^{31}, Trp^{32}, Nva^{34}\}$ NPY 31-36$\}$; neuropeptide Y, human, rat; neuropeptide Y 1-24 amide, human; biotinyl-neuropeptide Y; $\{D-Tyr^{27,36}, D-Thr^{32}\}$-NPY 27-36; Des 10-17 (cyclo 7-21) $\{Cys^{7,21}, Pro^{34}\}$-NPY; C2-NPY; $\{Leu^{31}, Pro^{34}\}$ neuropeptide Y, human neuropeptide Y, free acid, human; neuropeptide Y, free acid, porcine; prepro NPY 68-97, human; N-acetyl-$\{Leu^{28}, Leu^{31}\}$ NPY 24-36; neuropeptide Y, porcine; $\{D-Trp^{32}\}$-neuropeptide Y, porcine; $\{D-Trp^{32}\}$ NPY 1-36, human; $\{Leu^{17}, DTrp^{32}\}$1 neuropeptide Y, human; $\{Leu^{31}, Pro^{34}\}$-NPY, porcine; NPY 2-36, porcine; NPY 3-36, human; NPY 3-36, porcine; NPY 13-36, human; NPY 13-36, porcine; NPY 16-36, porcine; NPY 18-36, porcine; NPY 20-36; NFY 22-36; NPY 26-36; $\{Pro^{34}\}$-NPY 1-36, human; $\{Pro^{34}\}$-neuropeptide Y, porcine; PYX-1; PYX-2; T4-$\{NPY(33-36)\}$4; and Tyr(OMe)$^{21}\}$-neuropeptide Y, human.

Neurotropic factor peptides including, but not limited to, glial derived neurotropic factor (GDNF); brain derived neurotropic factor (BDNF); and ciliary neurotropic factor (CNTF).

Orexin peptides including, but not limited to, orexin A; orexin B, human; orexin B, rat, mouse.

Opioid peptides including, but not limited to, alpha-casein fragment 90-95; BAM-18P; casomokinin L; casoxin D; crystalline; DALDA; dermenkephalin (deltorphin) (Phylomedusa sauvagei); $\{D-Ala^2\}$-deltorphin I; $\{D-Ala^2\}$-deltorphin II; endomorphin-1; endomorphin-2; kyotorphin; $\{DArg^2\}$-kyotorphin; morphine tolerance peptide; morphine modulating peptide, C-terminal fragment; morphine modulating neuropeptide (A-18-F-NH2); nociceptin {orphanin FQ} (ORL1 agonist); TIPP; Tyr-MIF-1; Tyr-W-MIF-1; valorphin; LW-hemorphin-6, human; Leu-valorphin-Arg; and Z-Pro-D-Leu.

Oxytocin peptides including, but not limited to, $\{Asu^6\}$-oxytocin; oxytocin; biotinyl-oxytocin; $\{Thr^4, Gly^7\}$-oxytocin; and tocinoic acid ($\{Ile^3\}$-pressinoic acid).

PACAP (pituitary adenylating cyclase activating peptide) peptides including, but not limited to, PACAP 1-27, human, ovine, rat; PACAP (1-27)-Gly-Lys-Arg-NH$_2$, human; $\{Des-Gln^{16}\}$-PACAP 6-27, human, ovine, rat; PACAP38, frog; PACAP27-NH$_2$, human, ovine, rat; biotinyl-PACAP27-NH2, human, ovine, rat; PACAP 6-27, human, ovine, rat; PACAP38, human, ovine, rat; biotinyl-PACAP38, human, ovine, rat; PACAP 6-38, human, ovine, rat; PACAP27-NH$_2$, human, ovine, rat; biotinyl-PACAP27-NH$_2$, human, ovine, rat; PACAP 6-27, human, ovine, rat; PACAP38, human, ovine, rat; biotinyl-PACAP38, human, ovine, rat; PACAP 6-38, human, ovine, rat; PACAP38 16-38, human, ovine, rat; PACAP38 31-38, human, ovine, rat; PACAP38 31-38, human, ovine, rat; PACAP-related peptide (PRP), human; and PACAP-related peptide (PRP), rat.

Pancreastatin peptides including, but not limited to, chromostatin, bovine; pancreastatin (hPST-52) (chromogranin A 250-301, amide); pancreastatin 24-52 (hPST-29), human; chromogranin A 286-301, amide, human; pancreastatin, porcine; biotinyl-pancreastatin, porcine; $\{Nle^8\}$-pancreastatin, porcine; $\{Tyr^0, Nle^8\}$-pancreastatin, porcine; $\{Tyr^0\}$-pancreastatin, porcine; parastatin 1-19 (chromogranin A 347-365), porcine; pancreastatin (chromogranin A 264-314-amide, rat; biotinyl-pancreastatin (biotinyl-chromogranin A 264-314-amide; $\{Tyr^0\}$-pancreastatin, rat; pancreastatin 26-51, rat; and pancreastatin 33-49, porcine.

Pancreatic polypeptides including, but not limited to, pancreatic polypeptide, avian; pancreatic polypeptide, human; C-fragment pancreatic polypeptide acid, human; C-fragment pancreatic polypeptide amide, human; pancreatic polypeptide (Rana temporaria); pancreatic polypeptide, rat; and pancreatic polypeptide, salmon.

Parathyroid hormone peptides including, but not limited to, $\{Asp^{76}\}$-parathyroid hormone 39-84, human; $\{Asp^{76}\}$-parathyroid hormone 53-84, human; $\{Asn^{76}\}$-parathyroid hormone 1-84, hormone; $\{Asn^{76}\}$-parathyroid hormone 64-84, human; $\{Asn^8, Leu^{18}\}$-parathyroid hormone 1-34, human; $\{Cys^{5,28}\}$-parathyroid hormone 1-34, human; hypercalcemia malignancy factor 1-40; $\{Leu^{18}\}$-parathyroid hormone 1-34, human; $\{Lys(biotinyl)^{13}, Nle^{8,18}, Tyr^{34}\}$-parathyroid hormone 1-34 amide; $\{Nle^{8,18}, Tyr^{34}\}$-parathyroid hormone 1-34 amide; $\{Nle^{8,18}, Tyr^{34}\}$-parathyroid hormone 3-34 amide, bovine; $\{Nle^{8,18}, Tyr^{34}\}$-parathyroid hormone 1-34, human; $\{Nle^{8,18}, Tyr^{34}\}$-parathyroid hormone 1-34 amide human; $\{Nle^{8,18}, Tyr^{34}\}$-parathyroid hormone 3-34 amide, human; $\{Nle^{8,18}, Tyr^{34}\}$-parathyroid hormone 7-34 amide, bovine; $\{Nle^{8,21}, Tyr^{34}\}$-parathyroid hormone 1-34 amide, rat; parathyroid hormone 44-68, human; parathyroid hormone 1-34, bovine; parathyroid hormone 3-34, bovine; parathyroid hormone 1-31 amide, human; parathyroid hormone 1-34, human; parathyroid hormone 13-34, human; parathyroid hormone 1-34, rat; parathyroid hormone 1-38, human; parathyroid hormone 1-44, human; parathyroid hormone 28-48, human; parathyroid hormone 39-68, human; parathyroid hormone 39-84, human; parathyroid hormone 53-84, human; parathyroid hormone 69-84, human; parathyroid hormone 70-84, human; $\{Pro^{34}\}$-peptide YY (PYY), human; $\{Tyr^0\}$-hypercalcemia malignancy factor 1-40; $\{Tyr^0\}$-parathyroid hormone 1-44, human; $\{Tyr^0\}$-parathyroid hormone 1-34, human; $\{Tyr^1\}$-parathyroid hormone 1-34, human; $\{Tyr^{27}\}$-parathyroid hormone 27-48, human; $\{Tyr^{34}\}$-parathyroid hormone 7-34 amide, bovine; $\{Tyr^{43}\}$-parathyroid hormone 43-68, human; $\{Tyr^{52}, Asn^{76}\}$-parathyroid hormone 52-84, human; and $\{Tyr^{63}\}$-parathyroid hormone 63-84, human.

Parathyroid hormone (PTH)-related peptides including, but not limited to, PTHrP ($\{Tyr^{36}\}$-PTHrP 1-36 amide), chicken; hHCF-(1-34)-NH2 (humoral hypercalcemic factor), human; PTH-related protein 1-34, human; biotinyl-PTH-related protein 1-34, human; $\{Tyr^0\}$-PTH-related protein 1-34, human; $\{Tyr^{34}\}$-PTH-related protein 1-34 amide, human; PTH-related protein 1-37, human; PTH-related protein 7-34 amide, human; PTH-related protein 38-64 amide, human; PTH-related protein 67-86 amide, human; PTH-related protein 107-111, human, rat, mouse; PTH-related protein 107-111 free acid; PTH-related protein 107-138, human; and PTH-related protein 109-111, human.

Peptide T peptides including, but not limited to, peptide T; $\{D-Ala^1\}$-peptide T; and $\{D-Ala^1\}$-peptide T amide.

Prolactin-releasing peptides including, but not limited to, prolactin-releasing peptide 31, human; prolactin-releasing peptide 20, human; prolactin-releasing peptide 31, rat; prolactin-releasing peptide 20, rat; prolactin-releasing peptide 31, bovine; and prolactin-releasing peptide 20, bovine.

Peptide YY (PYY) peptides including, but not limited to, PYY, human; PYY 3-36, human; biotinyl-PYY, human; PYY, porcine, rat; and {Leu$^{31}$, Pro$^{34}$}-PYY, human.

Renin substrate peptides including, but not limited to, acetyl, angiotensinogen 1-14, human; angiotensinogen 1-14, porcine; renin substrate tetradecapeptide, rat; {Cys$^8$}-renin substrate tetradecapeptide, rat; {Leu$^8$}-renin substrate tetradecapeptide, rat; and {Val$^8$}-renin substrate tetradecapeptide, rat.

Secretin peptides including, but not limited to, secretin, canine; secretin, chicken; secretin, human; biotinyl-secretin, human; secretin, porcine; and secretin, rat.

Somatostatin (GIF) peptides including, but not limited to, BIM-23027; biotinyl-somatostatin; biotinylated cortistatin 17, human; cortistatin 14, rat; cortistatin 17, human; {Tyr$^0$}-cortistatin 17, human; cortistatin 29, rat; {D-Trp$^8$}-somatostatin; {DTrp$^8$,DCys$^{14}$}-somatostatin; {DTrp$^8$,Tyr$^{11}$}-somatostatin; {D-Trp$^8$}-somatostatin; NTB (Naltriben); {Nle$^8$}-somatostatin 1-28; octreotide (SMS 201-995); prosomatostatin 1-32, porcine; {Tyr$^0$}-somatostatin; {Tyr$^0$}-somatostatin; {Tyr$^1$}-somatostatin 28 (1-14); {Tyr$^{11}$}-somatostatin; {Tyr$^0$}, D-Trp$^8$}-somatostatin; somatostatin; somatostatin antagonist; somatostatin-25; somatostatin-28; somatostatin 28 (1-12); biotinyl-somatostatin-28; {Tyr$^0$}-somatostatin-28; {Leu$^8$, D-Trp$^{22}$, Tyr$^{25}$}-somatostatin-28; biotinyl-{Leu$^8$, D-Trp$^{22}$, Tyr$^{25}$}-somatostatin-28; somatostatin-28 (1-14); and somatostatin analog, RC-160.

Substance P peptides including, but not limited to, G protein antagonist-2; Ac-{Arg$^6$, Sar$^9$, Met(02)$^{11}$}-substance P 6-11; {Arg$^3$}-substance P; Ac-Trp-3,5-bis(trifluoromethyl)benzyl ester; Ac-{Arg$^6$, Sar$^9$, Met(O2)$^{11}$}-substance P 6-11; {D-Ala$^4$}-substance P 4-11; {Tyr$^6$, D-Phe$^7$, D-His$^9$}-substance P 6-11 (sendide); biotinyl-substance P; biotinyl-NTE{Arg$^3$}-substance P; (Tyr$^8$)-substance P; {Sar$^9$, Met (O2)$^{11}$}-substance P; {D-Pro$^2$, DTrp$^{7,9}$}-substance P; {D-Pro$^4$, O-Trp$^{7,9}$}-substance P 4-11; substance P 4-11; {DTrp$^{2,7,9}$}-substance P; {(Dehydro)Pro$^{2,4}$, Pro$^9$}-substance P; {Dehydro-Pro$^4$}-substance P 4-11; {Glp$^5$,(Me) Phe$^8$,Sar$^9$}-substance P 5-11; {Glp$^5$,Sar$^9$}-substance P 5-11; {Glp$^5$}-substance P 5-11; hepta-substance P (substance P 5-11); hexa-substance P (substance P 6-11); {MePhe$^8$,Sar$^9$}-substance P; {Nle$^{11}$}-substance P; Octa-substance P (substance P 4-11); {pGlu$^1$}-hexa-substance P ({pGlu$^6$}-substance P 6-11); {pGlu$^6$, D-Pro$^9$}-substance P 6-11; {(pNO$_2$) Phe$^7$ Nle$^{11}$}-substance P; penta-substance P (substance P 7-11); {Pro$^9$}-substance P; GR73632, substance P 7-11; {Sar$^4$}-substance P 4-11; {Sar$^9$}-substance P; septide ({pGlu$^6$, Pro$^9$}-substance P 6-11); spantide I; spantide II; substance P; substance P, cod; substance P, trout; substance P antagonist; substance P-Gly-Lys-Arg; substance P 1-4; substance P 1-6; substance P 1-7; substance P 1-9; deca-substance P (substance P 2-11); nona-substance P (substance P 3-11); substance P tetrapeptide (substance P 8-11); substance P tripeptide (substance P 9-11); substance P, free acid; substance P methyl ester, and {Tyr$^8$,Nle$^{11}$} substance P.

Tachykinin peptides including, but not limited to, {Ala$^5$, beta-Ala$^8$} neurokinin A 4-10; eledoisin; locustatachykinin I (Lom-TK-I) (*Locusta migratoria*); locustatachykinin II (Lom-TK-II) (*Locusta migratoria*); neurokinin A 4-10; neurokinin A (neuromedin L, substance K); neurokinin A, cod and trout; biotinyl-neurokinin A (biotinyl-neuromedin L, biotinyl-substance K); {Tyr$^0$}-neurokinin A; {Tyr$^6$}-substance K; FR64349; {Lys$^3$, Gly$^8$-(R)-gamma-lactam-Leu$^9$}-neurokinin A 3-10; GR83074; GR87389; GR94800; {Beta-Ala$^8$}-neurokinin A 4-10; {Nle$^{10}$}-neurokinin A 4-10; {Trp$^7$, beta-Ala$^8$}-neurokinin A 4-10; neurokinin B (neuromedin K); biotinyl-neurokinin B (biotinyl-neuromedin K); {MePhe$^7$}-neurokinin B; {Pro$^7$}-neurokinin B; {Tyr$^0$}-neurokinin B; neuromedin B, porcine; biotinyl-neuromedin B, porcine; neuromedin B-30, porcine; neuromedin B-32, porcine; neuromedin B receptor antagonist; neuromedin C, porcine; neuromedin N, porcine; neuromedin (U-8), porcine; neuromedin (U-25), porcine; neuromedin U, rat; neuropeptide-gamma (gamma-preprotachykinin 72-92); PG-KII; phyllolitorin; {Leu$^8$}-phyllolitorin (Phyllomedusa sauvagei); physalaemin; physalaemin 1-11; scyliorhinin II, amide, dogfish; senktide, selective neurokinin B receptor peptide; {Ser$^e$}-neuromedin C; beta-preprotachykinin 69-91, human; beta-preprotachykinin 111-129, human; tachyplesin I; xenopsin; and xenopsin 25 (xenin 25), human.

Thyrotropin-releasing hormone (TRH) peptides including, but not limited to, biotinyl-thyrotropin-releasing hormone; {Glu$^1$}-TRH; His-Pro-diketopiperazine; {3-Me-His$^2$}-TRH; pGlu-Gln-Pro-amide; pGlu-His; {Phe$^2$}-TRH; prepro TRH 53-74; prepro TRH 83-106; prepro-TRH 160-169 (Ps4, TRH-potentiating peptide); prepro-TRH 178-199, thyrotropin-releasing hormone (TRH); TRH, free acid; TRH-SH Pro; and TRH precursor peptide.

Toxin peptides including, but not limited to, omega-agatoxin TK; agelenin, (spider, *Agelena opulenta*); apamin (honeybee, *Apis mellifera*); calcicudine (CaC) (green mamba, *Dedroaspis angusticeps*); calciseptine (black mamba, *Dendroaspis polylepis polylepis*); charybdotoxin (ChTX) (scorpion, *Leiurus quinquestriatus* var. *hebraeus*); chlorotoxin; conotoxin GI (marine snail, *Conus geographus*); conotoxin GS (marine snail, *Conus geographus*); conotoxin MI (Marine *Conus magus*); alpha-conotoxin EI, *Conus ermineus*; alpha-conotoxin SIA; alpha-conotoxin ImI; alpha-conotoxin SI (cone snail, *Conus striatus*); micro-conotoxin GIIIB (marine snail, *Conus geographus*); omega-conotoxin GVIA (marine snail, *Conus geographus*); omega-conotoxin MVIIA (*Conus magus*); omega-conotoxin MVIIC (*Conus magus*); omega-conotoxin SVIB, (cone snail, *Conus striatus*); endotoxin inhibitor; geographutoxin I (GTX-I) (.mu.-Conotoxin GIIIA); iberiotoxin (IbTX) (scorpion, *Buthus tamulus*); kaliotoxin 1-37; kaliotoxin (scorpion, *Androctonus mauretanicus mauretanicus*); mast cell-degranulating peptide (MCD-peptide, peptide 401); margatoxin (MgTX) (scorpion, *Centruriodes Margaritatus*); neurotoxin NSTX-3 (Papua New Guinean spider, *Nephilia maculata*); PLTX-II (spider, *Plectreurys tristes*); scyllatoxin (leiurotoxin I); and stichodactyla toxin (ShK).

Vasoactive intestinal peptides (VIP/PHI) including, but not limited to, VIP, human, porcine, rat, ovine; VIP-Gly-Lys-Arg-NH$_2$; biotinyl-PHI (biotinyl-PHI-27), porcine; {Glp$^{16}$} VIP 16-28, porcine; PHI (PHI-27), porcine; PHI (PHI-27), rat; PHM-27 (PHI), human; prepro VIP 81-122, human; preproVIP/PHM 111-122; prepro VIP/PHM 156-170; biotinyl-PHM-27 (biotinyl-PHI), human; vasoactive intestinal contractor (endothelin-beta); vasoactive intestinal octacosa-peptide, chicken; vasoactive intestinal peptide, guinea pig; biotinyl-VIP, human, porcine, rat; vasoactive intestinal peptide 1-12, human, porcine, rat; vasoactive intestinal peptide 10-28, human, porcine, rat; vasoactive intestinal peptide 11-28, human, porcine, rat, ovine; vasoactive intestinal peptide (cod, Gadus morhua); vasoactive intestinal peptide 6-28; vasoactive intestinal peptide antagonist; vasoactive intestinal peptide antagonist ({Ac-Tyr$^1$, D-Phe$^2$}-GHRF 1-29 amide); vasoactive intestinal peptide receptor antagonist (4-Cl-D-Phe$^6$, Leu$^{17}$}-VIP); and vasoactive intestinal peptide receptor binding inhibitor, L-8-K. Additional constructs include but are not limited to, Ala{11,22,28}VIP, Ala{2,8,9,11,19,22,24,25,27,28}VIP, {K15, R16, L27}-VIP(1-7)/GRF(8-27), Ro25-1553, Ro25-1392, BAY55-9837, R3P65, Maxadilan, PG97-269, PG99-465, Max.d.4., and M65 (Dickson & Finlayson, Pharmacology & Therapeutics, Volume 121, Issue 3, March 2009, Pages 294-316).

Vasopressin (ADH) peptides including, but not limited to, vasopressin; {Asu$^{1,6}$,Arg$^8$}-vasopressin; vasotocin; {Asu$^{1,6}$,Arg$^8$}-vasotocin; {Lys$^8$}-vasopressin; pressinoic acid; {Arg$^8$}-desamino vasopressin desglycinamide; {Arg$^8$}-vasopressin (AVP); {Arg$^8$}-vasopressin desglycinamide; biotinyl-{Arg$^8$}-vasopressin (biotinyl-AVP); {D-Arg$^8$}-vasopressin; desamino-{Arg$^8$}-vasopressin; desamino-{D-Arg$^8$}-vasopressin (DDAVP); deamino-{D-3-(3'-pyridyl-Ala)}-{Arg$^8$}-vasopressin; {1-(beta-Mercapto-beta, beta-cyclopentamethylene propionic acid), 2-(O-methyl)tyrosine}-{Arg$^8$}-vasopressin; vasopressin metabolite neuropeptide {pGlu$^4$, Cys$^6$}; vasopressin metabolite neuropeptide {pGlu$^4$, Cys$^6$}; {Lys$^8$}-deamino vasopressin desglycinamide; {Lys$^8$}-vasopressin; {Mpr$^1$, Val$^4$,DArg$^8$}-vasopressin; {Phe$^2$, Ile$^a$, Orn$^8$}-vasopressin ({Phe$^2$, Orn$^8$}-vasotocin); {Arg$^8$}-vasotocin; and {d(CH$_2$)$_5$, Tyr(Me)$_2$, Orn$^8$}-vasotocin.

Virus related peptides including, but not limited to, viral membrane fusion proteins, fluorogenic human CMV protease substrate; HCV core protein 59-68; HCV NS4A protein 1840 (JT strain); HCV NS4A protein 21-34 (JT strain); hepatitis B virus receptor binding fragment; hepatitis B virus pre-S region 120-145; {Ala$^{127}$}-hepatitis B virus pre-S region 120-131; herpes virus inhibitor 2; HIV envelope protein fragment 254-274; HIV gag fragment 129-135; HIV substrate; P 18 peptide; peptide T; {3,5 diiodo-Tyr$^7$} peptide T; R15K HIV-1 inhibitory peptide; T20; T21; V3 decapeptide P 18-110; and virus replication inhibiting peptide.

The human hormone glucagon is a 29-amino acid peptide hormone produced in the A-cells of the pancreas. The hormone belongs to a multi-gene family of structurally related peptides that include secretin, gastric inhibitory peptide, vasoactive intestinal peptide and glicentin. These peptides variously regulate carbohydrate metabolism, gastrointestinal mobility and secretory processing. The principal recognized actions of pancreatic glucagon, however, are to promote hepatic glycogenolysis and glyconeogenesis, resulting in an elevation of blood sugar levels. In this regard, the actions of glucagon are counter regulatory to those of insulin and may contribute to the hyperglycemia that accompanies Diabetes mellitus {(Lund, P. K., et al., Proc. Natl. Acad. Sci. U.S.A., 79:345-349 (1982)}.

Glucagon has been found to be capable of binding to specific receptors which lie on the surface of insulin producing cells. Glucagon, when bound to these receptors, stimulates the rapid synthesis of cAMP by these cells. cAMP, in turn, has been found to stimulate insulin expression {Korman, L. Y., et al., Diabetes, 34:717-722 (1985)}. Insulin acts to inhibit glucagon synthesis {Ganong, W. F., Review of Medical Physiology, Lange Publications, Los Altos, Calif., p. 273 (1979)}. Thus, the expression of glucagon is carefully regulated by insulin, and ultimately by the serum glucose level.

The glucagon gene is initially translated from a 360 base pair precursor to form the polypeptide, preproglucagon {Lund, et al., Proc. Natl. Acad. Sci. U.S.A. 79:345-349 (1982)}. This polypeptide is subsequently processed to form proglucagon. Patzelt, C., et al., Nature, 282:260-266 (1979) demonstrated that proglucagon was subsequently cleaved into glucagon and a second polypeptide. Subsequent work by Lund, P. K., et al. supra, Lopez L. C., et al., Proc. Natl. Acad. Sci. U.S.A., 80:5485-5489 (1983), and Bell, G. I., et al., Nature 302:716-718 (1983), demonstrated that the proglucagon molecule was cleaved immediately after lysine-arginine dipeptide residues. Studies of proglucagon produced by channel catfish (*Ictalurus punctata*) indicated that glucagon from this animal was also proteolytically cleaved after adjacent lysine-arginine dipeptide residues {Andrews P. C., et al., J. Biol. Chem., 260:3910-3914 (1985), Lopez, L. C., et al., Proc. Natl. Acad. Sci. U.S.A., 80:5485-5489 (1983)}. Bell, G. I., et al., supra, discovered that mammalian proglucagon was cleaved at lysine-arginine or arginine-arginine dipeptides, and demonstrated that the proglucagon molecule contained three discrete and highly homologous peptide molecules which were designated glucagon, glucagon-like peptide 1 (GLP-1) and glucagon-like peptide 2 (GLP-2). Lopez, et al., concluded that glucagon-like peptide 1 was 37 amino acid residues long and that glucagon-like peptide 2 was 34 amino acid residues long. Analogous studies on the structure of rat preproglucagon revealed a similar pattern of proteolytic cleavage between adjacent lysine-arginine or arginine-arginine dipeptide residues, resulting in the formation of glucagon, GLP-1 and GLP-2 {Heinrich, G., et al., Endocrinol., 115:2176-2181 (1984)}.

Glucagon-like peptide-2 (GLP-2) is a 33 amino acid peptide expressed in a tissue-specific manner from the pleiotropic glucagon gene. GLP-2 shows remarkable homology in terms of amino acid sequence to glucagon and Glucagon-like peptide-1 (GLP-1). Further, different mammalian forms of GLP-2 are highly conserved. The sequence of human GLP-2, is as follows: His-Ala-Asp-Gly-Ser-Phe-Ser-Asp-Glu-Met-Asn-Thr-Ile-Leu-Asp-Asn-Leu-Ala-A-la-Arg-Asp-Phe-Ile-Asn-Trp-Leu-Ile-Gln-Thr-Lys-Ile-Thr-Asp. Further, a large number of agonist GLP-2 peptides that are described in PCT Application PCT/CA97/00252, filed Apr. 11, 1997. Analogs are described in U.S. Pat. No. 6,051,557, and examples of GLP-2 variants are found in U.S. Pat. Nos. 5,990,077 and 6,184,201.

Recently it was demonstrated that GLP-2 is an intestinotrophic peptide hormone (Drucker et al., (1996) PNAS, 93:7911-7916). When given exogenously, GLP-2 can produce a marked increase in the proliferation of small intestinal epithelium of the test mice, apparently with no undesirable side effects. Subsequently it was shown that peptide analogs of native GLP-2 with certain modifications to the peptide sequence possess enhanced intestinotrophic activity (U.S. patent application Ser. No. 08/669,791). Moreover, GLP-2 has also been shown to increase D-Glucose maximal transport rate across the intestinal basolateral membrane (Cheeseman and Tseng (1996) American Journal of Physiology 271: G477-G482).

A number of peptide hormones (IGF-2, IGF-1, GH), structurally unrelated to GLP-2, have been demonstrated to have varying degrees of intestinotrophic activity. (U.S. Pat. No. 5,482,926, WO 91/12018, U.S. Pat. No. 5,288,703). However, none of the above peptide hormones possess the efficacy or specificity of GLP-2 in promoting proliferation of the intestine epithelium. GLP-2 acts synergistically with the peptide hormones IGF-1 and/or GH to promote the proliferation of cells in the large intestine. Furthermore, the intestinotrophic effects on the small and large intestines of this combination therapy are greater than that seen with any one of alone. Coadministration of GLP-2 with IGF-2 to promote growth of small and/or large intestine tissue is discussed in U.S. Pat. No. 5,952,301.

Nucleic acid encoding the GLP-2 receptor has been isolated and methods to identify GLP-2 receptor agonists are described (U.S. patent application Ser. No. 08/767,224 and U.S. Ser. No. 08/845,546). GLP-2's role in diseases involving the esophagus and the stomach, in assisting patients at risk of developing a malfunctioning of the upper gastrointestinal tract, and in increasing tissue growth in the upper gastrointestinal tract have been discussed (see U.S. Pat. No. 6,051,557). GLP-2 receptor agonists act to enhance functioning of the large intestine. (U.S. Pat. No. 6,297,214). GLP-2 and peptidic agonists of GLP-2 can cause proliferation of the tissue of large intestine. GLP-2 may also be useful to treat or prevent inflammatory conditions of the large intestine, including inflammatory bowel diseases (U.S. Pat. No. 6,586,399).

A very wide variety of non-naturally encoded amino acids are suitable for use in the present invention. Any number of non-naturally encoded amino acids can be introduced into an analog. In general, the introduced non-naturally encoded amino acids are substantially chemically inert toward the 20 common, genetically-encoded amino acids (i.e., alanine, arginine, asparagine, aspartic acid, cysteine, glutamine, glutamic acid, glycine, histidine, isoleucine, leucine, lysine, methionine, phenylalanine, proline, serine, threonine, tryptophan, tyrosine, and valine). In some embodiments, the non-naturally encoded amino acids include side chain functional groups that react efficiently and selectively with functional groups not found in the 20 common amino acids (including but not limited to, azido, ketone, aldehyde and aminooxy groups) to form stable conjugates. For example, an analog that includes a non-naturally encoded amino acid containing an azido functional group can be reacted with a polymer (including but not limited to, poly(ethylene glycol) or, alternatively, a second polypeptide containing an alkyne moiety to form a stable conjugate resulting for the selective reaction of the azide and the alkyne functional groups to form a Huisgen {3+2} cycloaddition product.

In some embodiments, the composition or pharmaceutical compositions of the claimed invention comprises an analog of a polypeptide, wherein the analog amino acid sequence is based upon the fragments, polypeptides, and functional deriviatives disclosed herein and wherein the analog comprises at least one or a plurality of non-natural amino acids and at least one or a plurality of β-amino acid residues. A non-natural amino acid typically possesses an R group that is any substituent other than one component of the twenty natural amino acids, and may be suitable for use in the present invention. Because the non-naturally encoded amino acids of the invention typically differ from the natural amino acids only in the structure of the side chain, the non-naturally encoded amino acids form amide bonds with other amino acids, including but not limited to, natural or non-naturally encoded, in the same manner in which they are formed in naturally occurring polypeptides. However, the non-natural amino acids have side chain groups that distinguish them from the natural amino acids. For example, R optionally comprises an alkyl-, aryl-, acyl-, keto-, azido-, hydroxyl-, hydrazine, cyano-, halo-, hydrazide, alkenyl, alkynl, ether, thiol, seleno-, sulfonyl-, borate, boronate, phospho, phosphono, phosphine, heterocyclic, enone, imine, aldehyde, ester, thioacid, hydroxylamine, amino group, or the like or any combination thereof. Other non-naturally occurring amino acids of interest that may be suitable for use in the present invention include, but are not limited to, amino acids comprising a photoactivatable cross-linker, spin-labeled amino acids, fluorescent amino acids, metal binding amino acids, metal-containing amino acids, radioactive amino acids, amino acids with novel functional groups, amino acids that covalently or noncovalently interact with other molecules, photocaged and/or photoisomerizable amino acids, amino acids comprising biotin or a biotin analogue, glycosylated amino acids such as a sugar substituted serine, other carbohydrate modified amino acids, keto-containing amino acids, amino acids comprising polyethylene glycol or polyether, heavy atom substituted amino acids, chemically cleavable and/or photocleavable amino acids, amino acids with an elongated side chains as compared to natural amino acids, including but not limited to, polyethers or long chain hydrocarbons, including but not limited to, greater than about 5 or greater than about 10 carbons, carbon-linked sugar-containing amino acids, redox-active amino acids, amino thioacid containing amino acids, and amino acids comprising one or more toxic moiety.

Exemplary non-natural amino acids that may be suitable for use in the present invention and that are useful for reactions with water soluble polymers include, but are not limited to, those with carbonyl, aminooxy, hydrazine, hydrazide, semicarbazide, azide and alkyne reactive groups. In some embodiments, non-naturally encoded amino acids comprise a saccharide moiety. Examples of such amino acids include N-acetyl-L-glucosaminyl-L-serine, N-acetyl-L-galactosaminyl-L-serine, N-acetyl-L-glucosaminyl-L-threonine, N-acetyl-L-glucosaminyl-L-asparagine and O-mannosaminyl-L-serine. Examples of such amino acids also include examples where the naturally-occurring N- or O-linkage between the amino acid and the saccharide is replaced by a covalent linkage not commonly found in nature-including but not limited to, an alkene, an oxime, a thioether, an amide and the like. Examples of such amino acids also include saccharides that are not commonly found in naturally-occurring proteins such as 2-deoxy-glucose, 2-deoxygalactose and the like.

Many of the non-naturally encoded amino acids provided herein are commercially available, e.g., from Sigma-Aldrich (St. Louis, Mo., USA), Novabiochem (a division of EMD Biosciences, Darmstadt, Germany), or Peptech (Burlington, Mass., USA). Those that are not commercially available are optionally synthesized as provided herein or using standard methods known to those of skill in the art. In some embodiments, the invention relates to a method of manufacturing a polypeptide analog wherein the polypeptide analog is manufactured using a synthesis technique disclosed in the following references, which are incorporated herein by reference: For organic synthesis techniques, see, e.g., Organic Chemistry by Fessendon and Fessendon, (1982, Second Edition, Willard Grant Press, Boston Mass.); Advanced Organic Chemistry by March (Third Edition, 1985, Wiley and Sons, New York); and Advanced Organic Chemistry by Carey and Sundberg (Third Edition, Parts A and B, 1990, Plenum Press, New York). See, also, U.S. Patent Application Publications 2003/0082575 and 2003/0108885, which is incorporated by reference herein. In addition to unnatural (or non-natural) amino acids that contain novel side chains, unnatural amino acids that may be suitable for use in the present invention also optionally comprise modified backbone structures, including but not limited to, as illustrated by the structures of Formula II and III of U.S. Patent Application Publication 2010-0048871, wherein Z typically comprises OH, NH$_2$, SH, NH—R', or S—R'; X and Y, which can be the same or different, typically comprise S or O, and R and R', which are optionally the same or different, are typically selected from the same list of constituents for the R group described above for the unnatural amino acids as well as hydrogen. For example, unnatural amino acids of the invention optionally comprise substitutions in the amino or carboxyl group as illustrated by Formulas II and III. Unnatural amino acids of this type include, but are not limited to, α-hydroxy acids, α-thioacids, α-aminothiocarboxylates, including but not limited to, with side chains corresponding to the common twenty natural amino acids or unnatural side chains. In addition, substitutions at the α-carbon optionally include, but are not limited to, L, D, or α-α-disubstituted amino acids such as D-glutamate, D-alanine, D-methyl-O-tyrosine, aminobutyric acid, and the like. Other structural alternatives include cyclic amino acids, such as proline analogues as well as 3, 4, 6, 7, 8, and 9 membered ring proline analogues, β amino acids such as substituted β-alanine.

In some embodiments, the composition or pharmaceutical compositions of the claimed invention comprises an analog of a polypeptide, wherein the analog amino acid sequence is based upon the fragments, polypeptides, and functional deriviatives disclosed herein and wherein the analog comprises at least one or a plurality of unnatural amino acid or non-natural amino acid and at least one or a plurality of β-amino acid residues, wherein the unnatural amino acids based on natural amino acids, such as tyrosine, glutamine, phenylalanine, and the like, and are suitable for use in the present invention. Tyrosine analogs include, but are not limited to, para-substituted tyrosines, ortho-substituted tyrosines, and meta substituted tyrosines, where the substituted tyrosine comprises, including but not limited to, a keto group (including but not limited to, an acetyl group), a benzoyl group, an amino group, a hydrazine, an hydroxyamine, a thiol group, a carboxy group, an isopropyl group, a methyl group, a $C_6$-$C_{20}$ straight chain or branched hydrocarbon, a saturated or unsaturated hydrocarbon, an O-methyl group, a polyether group, a nitro group, an alkynyl group or the like. In addition, multiply substituted aryl rings are also contemplated. Glutamine analogs that may be suitable for use in the present invention include, but are not limited to, α.-hydroxy derivatives, cyclic derivatives, and amide substituted glutamine derivatives. Example phenylalanine analogs that may be suitable for use in the present invention include, but are not limited to, para-substituted phenylalanines, ortho-substituted phenyalanines, and meta-substituted phenylalanines, where the substituent comprises, including but not limited to, a hydroxy group, a methoxy group, a methyl group, an allyl group, an aldehyde, an azido, an iodo, a bromo, a keto group (including but not limited to, an acetyl group), a benzoyl, an alkynyl group, or the like. Specific examples of unnatural amino acids that may be suitable for use in the present invention include, but are not limited to, a p-acetyl-L-phenylalanine, an O-methyl-L-tyrosine, an L-3-(2-naphthyl)alanine, a 3-methyl-phenylalanine, an 0-4-allyl-L-tyrosine, a 4-propyl-L-tyrosine, a tri-O-acetyl-GlcNAcβ-serine, an L-Dopa, a fluorinated phenylalanine, an isopropyl-L-phenylalanine, a p-azido-L-phenylalanine, a p-acyl-L-phenylalanine, a p-benzoyl-L-phenylalanine, an L-phosphoserine, a phosphonoserine, a phosphonotyrosine, a p-iodo-phenylalanine, a p-bromophenylalanine, a p-amino-L-phenylalanine, an isopropyl-L-phenylalanine, and a p-propargyloxy-phenylalanine, and the like. Examples of structures of a variety of unnatural amino acids that may be suitable for use in the present invention are provided in, for example, WO 2002/085923 entitled "In vivo incorporation of unnatural amino acids." See also Kiick et al., (2002). Incorporation of azides into recombinant proteins for chemoselective modification by the Staudinger ligation, *PNAS* 99:19-24, for additional methionine analogs.

The chemical moieties via unnatural amino acids that can be incorporated into analogs offer a variety of advantages and manipulations of the protein. For example, the unique reactivity of a keto functional group allows selective modification of proteins with any of a number of hydrazine- or hydroxylamine-containing reagents in vitro and in vivo. A heavy atom unnatural amino acid, for example, can be useful for phasing X-ray structure data. The site-specific introduction of heavy atoms using unnatural amino acids also provides selectivity and flexibility in choosing positions for heavy atoms. In some embodiments, the composition or pharmaceutical compositions of the claimed invention comprises an analog of a polypeptide, wherein the analog amino acid sequence is based upon the fragments, polypeptides, and functional deriviatives disclosed herein and wherein the analog comprises at least one or a plurality of unnatural amino acid or non-natural amino acid and at least one or a plurality of β-amino acid residues, wherein the unnatural amino is a photoreactive unnatural amino acid chosen from (including but not limited to, amino acids with benzophenone and arylazides (including but not limited to, phenylazide) side chains), for example, allow for efficient in vivo and in vitro photocrosslinking of protein. Examples of photoreactive unnatural amino acids include, but are not limited to, p-azido-phenylalanine and p-benzoyl-phenylalanine. The protein with the photoreactive unnatural amino acids can then be crosslinked at will by excitation of the photoreactive group-providing temporal control. In one example, the methyl group of an unnatural amino can be substituted with an isotopically labeled, including but not limited to, methyl group, as a probe of local structure and dynamics, including but not limited to, with the use of nuclear magnetic resonance and vibrational spectroscopy. Alkynyl or azido functional groups, for example, allow the selective modification of proteins with molecules through a {3+2} cycloaddition reaction.

A non-natural amino acid incorporated into a polypeptide at the amino terminus can be composed of an R group that is any substituent other than one used in the twenty natural amino acids and a second reactive group different from the $NH_2$ group normally present in α-amino acids. A similar non-natural amino acid can be incorporated at the carboxyl terminus with a second reactive group different from the COOH group normally present in α-amino acids.

Many of the unnatural amino acids suitable for use in the present invention are commercially available, e.g., from Sigma (USA) or Aldrich (Milwaukee, Wis., USA). Those that are not commercially available are optionally synthesized as provided herein or as provided in various publications or using standard methods known to those of skill in the art. For organic synthesis techniques, see, e.g., Organic Chemistry by Fessendon and Fessendon, (1982, Second Edition, Willard Grant Press, Boston Mass.); Advanced Organic Chemistry by March (Third Edition, 1985, Wiley and Sons, New York); and Advanced Organic Chemistry by Carey and Sundberg (Third Edition, Parts A and B, 1990, Plenum Press, New York). Additional publications describing the synthesis of unnatural amino acids include, e.g., WO 2002/085923 entitled "In vivo incorporation of Unnatural Amino Acids;" Matsoukas et al., (1995) J. Med. Chem., 38, 4660-4669; King, F. E. & Kidd, D. A. A. (1949) A New Synthesis of Glutamine and of γ-Dipeptides of Glutamic Acid from Phthylated Intermediates. J. Chem. Soc., 3315-3319; Friedman, 0. M. & Chattenji, R. (1959) Synthesis of Derivatives of Glutamine as Model Substrates for Anti-Tumor Agents. J. Am. Chem. Soc. 81, 3750-3752; Craig, J. C. et al. (1988) Absolute Configuration of the Enantiomers of 7-Chloro-4 {{4-(diethylamino)-}-methylbutyl}amino}quinoline (Chloroquine). J. Org. Chem. 53, 1167-1170; Azoulay, M., Vilmont, M. & Frappier, F. (1991) Glutamine analogues as Potential Antimalarials, Eur. J. Med. Chem. 26, 201-5; Koskinen, A. M. P. & Rapoport, H. (1989) Synthesis of 4-Substituted Prolines as Conformationally Constrained Amino Acid Analogues. J. Org. Chem. 54, 1859-1866; Christie, B. D. & Rapoport, H. (1985) Synthesis of Optically Pure Pipecolates from L-Asparagine. Application to the Total Synthesis of (+)-Apovincamine through Amino Acid Decarbonylation and Iminium Ion Cyclization. J. Org. Chem. 50:1239-1246; Barton et al., (1987) Synthesis of Novel alpha-Amino-Acids and Derivatives Using Radical Chemistry: Synthesis of L- and D-alpha-Amino-Adipic Acids, L-alpha-aminopimelic Acid and Appropriate Unsaturated Derivatives. Tetrahedron 43:4297-4308; and, Subasinghe et al., (1992) Quisqualic acid analogues: synthesis of beta-heterocyclic 2-aminopropanoic acid derivatives and their activity at a novel quisqualate-sensitized site. J. Med. Chem. 35:4602-7. See also, patent applications entitled "Protein Arrays," filed Dec. 22, 2003, Ser. No. 10/744,899 and Ser. No. 60/435,821 filed on Dec. 22, 2002.

In some embodiments, the composition comprises a transcription factor analog wherein the total number of β-amino acids in the analog is from about 10 percent to about 60 percent of the total number of amino acids of the analog. In some embodiments, the composition comprises an enkephlin analog wherein the total number of β-amino acids in the analog is from about 10 percent to about 60 percent of the total number of amino acids of the analog. In some embodiments, the composition comprises an LHRH analog wherein the total number of β-amino acids in the analog is from about 10 percent to about 60 percent of the total number of amino acids of the analog. In some embodiments, the composition comprises a neuropeptide analog wherein the total number of β-amino acids in the analog is from about 10 percent to about 60 percent of the total number of amino acids of the analog. In some embodiments, the composition comprises an glycointegrin analog wherein the total number of β-amino acids in the analog is from about 10 percent to about 60 percent of the total number of amino acids of the analog. In some embodiments, the composition comprises an integrin analog wherein the total number of β-amino acids in the analog is from about 10 percent to about 60 percent of the total number of amino acids of the analog. In some embodiments, the composition comprises a glucagon or glucagon-like peptide analog wherein the total number of β-amino acids in the analog is from about 10 percent to about 60 percent of the total number of amino acids of the analog. In some embodiments, the composition comprises an antithrombotic peptides analog wherein the total number of β-amino acids in the analog is from about 10 percent to about 60 percent of the total number of amino acids of the analog. In some embodiments, the composition comprises a vassopressin analog wherein the total number of β-amino acids in the analog is from about 10 percent to about 60 percent of the total number of amino acids of the analog. In some embodiments, the composition comprises a cytokine or interleukin analog wherein the total number of β-amino acids in the analog is from about 10 percent to about 60 percent of the total number of amino acids of the analog. In some embodiments, the composition comprises an interferon analog wherein the total number of β-amino acids in the analog is from about 10 percent to about 60 percent of the total number of amino acids of the analog. In some embodiments, the composition comprises an endothlin analog wherein the total number of β-amino acids in the analog is from about 10 percent to about 60 percent of the total number of amino acids of the analog. In some embodiments, the composition comprises an natriuretic hormone analog wherein the total number of β-amino acids in the analog is from about 10 percent to about 60 percent of the total number of amino acids of the analog. In some embodiments, the composition comprises an extracellular kinase ligand analog wherein the total number of β-amino acids in the analog is from about 10 percent to about 60 percent of the total number of amino acids of the analog. In some embodiments, the composition comprises an angiotensin enzyme inhibitor analog wherein the total number of β-amino acids in the analog is from about 10 percent to about 60 percent of the total number of amino acids of the analog. In some embodiments, the composition comprises an antiviral peptide analog wherein the total number of β-amino acids in the analog is from about 10 percent to about 60 percent of the total number of amino acids of the analog. In some embodiments, the composition comprises a thrombin analog wherein the total number of β-amino acids in the analog is from about 10 percent to about 60 percent of the total number of amino acids of the analog. In some embodiments, the composition comprises a substance P analog wherein the total number of β-amino acids in the analog is from about 10 percent to about 60 percent of the total number of amino acids of the analog. In some embodiments, the composition comprises a substance G analog wherein the total number of β-amino acids in the analog is from about 10 percent to about 60 percent of the total number of amino acids of the analog. In some embodiments, the composition comprises a somatotropin analog wherein the total number of β-amino acids in the analog is from about 10 percent to about 60 percent of the total number of amino acids of the analog. In some embodiments, the composition comprises a somatostatin analog wherein the total number of β-amino acids in the analog is from about 10 percent to about 60 percent of the total number of amino acids of the analog. In some embodiments, the composition comprises a GnRH analog wherein the total number of β-amino acids in the analog is from about 10 percent to about 60 percent of the total number of amino acids of the analog. In some embodiments, the composition comprises a bradykinin analog wherein the total number of β-amino acids in the analog is from about 10 percent to about 60 percent of the total number of amino acids of the analog. In some embodiments, the composition comprises an insulin analog wherein the total number of β-amino acids in the analog is from about 10 percent to about 60 percent of the total number of amino acids of the analog. In some embodiments, the composition comprises a growth factor analog wherein the total number of β-amino acids in the analog is from about 10 percent to about 60 percent of the total number of amino acids of the analog. Any of the compositions above may be used in the methods disclosed in this instant specification.

In some embodiments, the composition comprises a VIP analog wherein the total number of β-amino acids in the analog is from about 10 percent to about 60 percent of the total number of amino acids of the analog. In some embodiments, the composition comprises a VIP analog wherein the total number of β-amino acids in the analog is from about 12 percent to about 50 percent of the total number of amino acids of the analog. In some embodiments, the composition comprises a VIP analog wherein the total number of β-amino acids in the analog is from about 14 percent to about 50 percent of the total number of amino acids of the analog. In some embodiments, the composition comprises a VIP analog wherein the total number of β-amino acids in the analog is from about 16 percent to about 50 percent of the total number of amino acids of the analog. In some embodiments, the composition comprises a VIP analog wherein the total number of β-amino acids in the analog is from about 18 percent to about 50 percent of the total number of amino acids of the analog. In some embodiments, the composition comprises a VIP analog wherein the total number of β-amino acids in the analog is from about 20 percent to about 50 percent of the total number of amino acids of the analog. In some embodiments, the composition comprises a VIP analog wherein the total number of β-amino acids in the analog is from about 30 percent to about 50 percent of the total number of amino acids of the analog. In some embodiments, the composition comprises a VIP analog wherein the total number of β-amino acids in the analog is from about 40 percent to about 50 percent of the total number of amino acids of the analog. In some embodiments, the composition comprises a VIP analog wherein the total number of β-amino acids in the analog is from about 45 percent to about 50 percent of the total number of amino acids of the analog. In some embodiments, the composition comprises a VIP analog wherein the total number of β-amino acids in the analog is from about 40 percent to about 45 percent of the total number of amino acids of the analog. In some embodiments, the composition comprises a VIP analog wherein the total number of β-amino acids in the analog is from about 30 percent to about 40 percent of the total number of amino acids of the analog. In some embodiments, the composition comprises a VIP analog wherein the total number of β-amino acids in the analog is from about 35 percent to about 40 percent of the total number of amino acids of the analog. In some embodiments, the composition comprises a VIP analog wherein the total number of β-amino acids in the analog is from about 20 percent to about 30 percent of the total number of amino acids of the analog. In some embodiments, the composition comprises a VIP analog wherein the total number of β-amino acids in the analog is from about 10 percent to about 20 percent of the total number of amino acids of the analog. In some embodiments, the composition comprises a VIP analog wherein the total number of β-amino acids in the analog is from about 15 percent to about 20 percent of the total number of amino acids of the analog. In some embodiments, the composition comprises a VIP analog wherein the total number of β-amino acids in the analog is from about 20 percent to about 25 percent of the total number of amino acids of the analog. In some embodiments, the composition comprises a VIP analog wherein the total number of β-amino acids in the analog is from about 25 percent to about 30 percent of the total number of amino acids of the analog. In some embodiments, the composition comprises a VIP analog wherein the total number of β-amino acids in the analog is from about 30 percent to about 35 percent of the total number of amino acids of the analog.

In some embodiments, the composition comprises a VIP analog, wherein the ratio of total β-amino acids in the analog is from 1 to 3 β-amino acids for every 7 amino acids of the analog. In some embodiments, the composition comprises a VIP analog, wherein the ratio of total β-amino acids in the analog is from 2 to 4 β-amino acids for every 7 amino acids of the analog. In some embodiments, the composition comprises a VIP analog, wherein the ratio of total β-amino acids to amino acids in the analog is from 3 to 5 β-amino acids for every 7 amino acids of the analog. In some embodiments, the composition comprises a VIP analog, wherein the ratio of total β-amino acids to amino acids in the analog is from 4 to 6 β-amino acids for every 7 amino acids of the analog. In some embodiments, the composition comprises a VIP analog, wherein the ratio of total β-amino acids to amino acids in the analog is from 5 to 7 β-amino acids for every 7 amino acids of the analog. In some embodiments, the composition comprises a VIP analog, wherein the ratio of total β-amino acids to amino acids in the analog is 1 β-amino acid for every 7 amino acids of the analog. In some embodiments, the composition comprises a VIP analog, wherein the ratio of total β-amino acids to amino acids in the analog is 2 β-amino acids for every 7 amino acids of the analog. In some embodiments, the composition comprises a VIP analog, wherein the ratio of total β-amino acids to amino acids in the analog is 3 β-amino acids for every 7 amino acids of the analog. In some embodiments, the composition comprises a VIP analog, wherein the ratio of total β-amino acids to amino acids in the analog is 4 β-amino acids for every 7 amino acids of the analog. In some embodiments, the composition comprises a VIP analog, wherein the ratio of total β-amino acids to amino acids in the analog is 5 β-amino acids for every 7 amino acids of the analog. In some embodiments, the composition comprises a VIP analog, wherein the ratio of total β-amino acids to amino acids in the analog is 6 β-amino acids for every 7 amino acids of the analog.

In another embodiment of the invention, the composition comprises a VIP analog, wherein the analog comprises a repetitive pattern of β-amino acids from the amino-terminus to the carboxy-terminus selected from the following: ααααααβ, ααααα βα, αααα βαα, ααα βααα, αα βαααα, α βααααα, βαααααα, αααα ββ, ααα α ββα, ααα ββαα, αα ββααα, α ββαααα, ββααααα, βαααα αβ, βαααβα, βαα βαα, βα βααα, βα βαααα, α βαααα β, α βααα βα, α βα α βαα, α βα βααα, αα βααα β, αα βαα βα, αα βα βαα, ααα βαα β, ααα βα βα, and αααα βα β.

Some embodiments of the claimed invention include pharmaceutical compositions. In some embodiments, the pharmaceutical composition comprises any of the aforementioned compositions in combination with a pharmaceutically acceptable carrier. In another embodiment of the invention, the pharmaceutical composition comprises a secretin analog and one other active agent, wherein the secretin analog comprises at least one α-amino acid and at least one β-amino acid.

In another embodiment of the invention, the pharmaceutical composition comprises a VIP analog and one other active agent, wherein the VIP analog comprises at least one α-amino acid and at least one β-amino acid.

The invention further relates to uses of a composition comprising a secretin analog in the preparation of a medicament for treating or preventing pulmonary hypertension, primary arterial hypertension, pulmonary hypertension associated to post-ventricular septal defect, idiopathic pulmonary fibrosis, idiopathic pulmonary arterial hypertension, CREST syndrome—Calcinosis; Raynaud's disease; loss of muscle control of the Esophagus; Sclerodactyly; Telangiectasia, Acute respiratory distress, congestive heart failure, chronic obstructed pulmonary disorder, asthma, chronic obstructive pulmonary disease, sarcoidosis, small lung cell cancer, autoimmune disease, inflammatory disease, sepsis, Hirschsprung's Disease, sexual dysfunction, erectile dysfunction, Parkinson's disease, Alzheimer's disease, circadian rhythm dysfunction, pain, colorectal cancer, hepatocellular cancer, elevated blood pressure levels, elevated blood glucose levels, hyperglycemia, diabetes, insulin resistance, metabolic acidosis, obesity, Type I diabetes, Type II diabetes Multiple Sclerosis, osteoporosis, Sjogren's syndrome, pancreatitis, uveoretinitis, osteoporosis, female sexual dysfunction. The invention further relates to use of a composition comprising a VIP analog in the preparation of a medicament for treating or preventing pulmonary hypertension, primary arterial hypertension, pulmonary hypertension associated to post-ventricular septal defect, idiopathic pulmonary fibrosis, idiopathic pulmonary arterial hypertension, CREST syndrome—Calcinosis; Raynaud's disease; loss of muscle control of the Esophagus; Sclerodactyly; Telangiectasia, Acute respiratory distress, congestive heart failure, chronic obstructed pulmonary disorder, asthma, chronic obstructive pulmonary disease, sarcoidosis, small lung cell cancer, autoimmune disease, inflammatory disease, sepsis, Hirschsprung's Disease, sexual dysfunction, erectile dysfunction, Parkinson's disease, Alzheimer's disease, circadian rhythm dysfunction, pain, colorectal cancer, hepatocellular cancer, elevated blood pressure levels, elevated blood glucose levels, hyperglycemia, diabetes, insulin resistance, metabolic acidosis, obesity, Type I diabetes, Type II diabetes Multiple Sclerosis, osteoporosis, Sjogren's syndrome, pancreatitis, uveoretinitis, osteoporosis, female sexual dysfunction.

In some embodiments, the invention relates to methods of manufacturing any one of the aforementioned compositions, pharmaceutical compositions, or a pharmaceutical salt derived therefrom comprising catalyzing a reaction between at least one α-amino acid with at least one β-amino acid.

The invention also relates to methods of treating or preventing pulmonary hypertension, primary arterial hypertension, pulmonary hypertension associated to post-ventricular septal defect, idiopathic pulmonary fibrosis, idiopathic pulmonary arterial hypertension, CREST syndrome—Calcinosis; Raynaud's disease; loss of muscle control of the Esophagus; Sclerodactyly; Telangiectasia, Acute respiratory distress, congestive heart failure, chronic obstructed pulmonary disorder, asthma, chronic obstructive pulmonary disease, sarcoidosis, small lung cell cancer, autoimmune disease, inflammatory disease, sepsis, Hirschsprung's Disease, sexual dysfunction, erectile dysfunction, Parkinson's disease, Alzheimer's disease, circadian rhythm dysfunction, pain, colorectal cancer, hepatocellular cancer, elevated blood pressure levels, elevated blood glucose levels, hyperglycemia, diabetes, insulin resistance, metabolic acidosis, obesity, Type I diabetes, Type II diabetes Multiple Sclerosis, osteoporosis, Sjogren's syndrome, pancreatitis, uveoretinitis, osteoporosis, female sexual dysfunction comprising administrating any one of the compositions or pharmaceutical compositions comprising a secretin family analog, or a pharmaceutical salt derived therefrom, to a subject in need thereof.

The present invention also relates to methods of inhibiting secretion of TNF-α in a subject comprising administering a composition comprising a vasoactive intestinal peptide (VIP) analog to a subject, wherein said analog comprises an α-amino acid and at least one β-amino acid. In some embodiments, the method comprises administering the composition comprising any of the percentages of β-amino acids.

The present invention is also directed towards kits comprising any of the aforementioned compositions or pharmaceutical compositions comprising a secretin analog, wherein the secretin analog comprises an α-amino acid and at least one β-amino. The present invention is directed toward kits comprising any of the aforementioned compositions or pharmaceutical compositions comprising a VIP analog, wherein the VIP analog comprises an α-amino acid and at least on β-amino acid. In some embodiments, the kit further comprises a vehicle for administration of the composition.

The present invention also relates to methods of identifying a modulator of human receptor activity comprising:

a) contacting a human receptor with a secretin analog, wherein the analog comprises an α-amino acid and at least one β-amino acid;

b) measuring the association of the secretin analog to the human receptor in the presence and absence of an unknown compound; and c) comparing the rate of association of the secretin analog to the human receptor in the presence of an unknown compound to the rate of association of the secretin analog to the human receptor in the absence of an unknown compound.

The present invention also relates to methods of identifying a modulator of animal receptor activity comprising:

a) contacting an animal receptor with a secretin analog, wherein the analog comprises an α-amino acid and at least one β-amino acid;

b) measuring the association of the secretin analog to the animal receptor in the presence and absence of an unknown compound; and c) comparing the rate of association of the secretin analog to the animal receptor in the presence of an unknown compound to the rate of association of the secretin analog to the animal receptor in the absence of an unknown compound.

The present invention also relates to methods of identifying a modulator of human secretin receptor activity comprising:

a) contacting a human secretin receptor with a secretin analog, wherein the analog comprises an α-amino acid and at least one β-amino acid;

b) measuring the association of the secretin analog to the human secretin receptor in the presence and absence of an unknown compound; and c) comparing the rate of association of the secretin analog to the human secretin receptor in the presence of an unknown compound to the rate of association of the secretin analog to the human secretin receptor in the absence of an unknown compound.

The present invention also relates to methods of identifying a modulator of human VIP receptor activity comprising:

a) contacting a human VIP receptor with the VIP analog, wherein the analog comprises an α-amino acid and at least one β-amino acid;

b) measuring the association of the VIP analog to the human VIP receptor in the presence and absence of an unknown compound; and c) comparing the rate of association of the VIP analog to the human VIP receptor in the presence of an unknown compound to the rate of association of the VIP analog to the human VIP receptor in the absence of an unknown compound.

DETAILED DESCRIPTION OF ILLUSTRATIVE EMBODIMENTS

Figure 1:
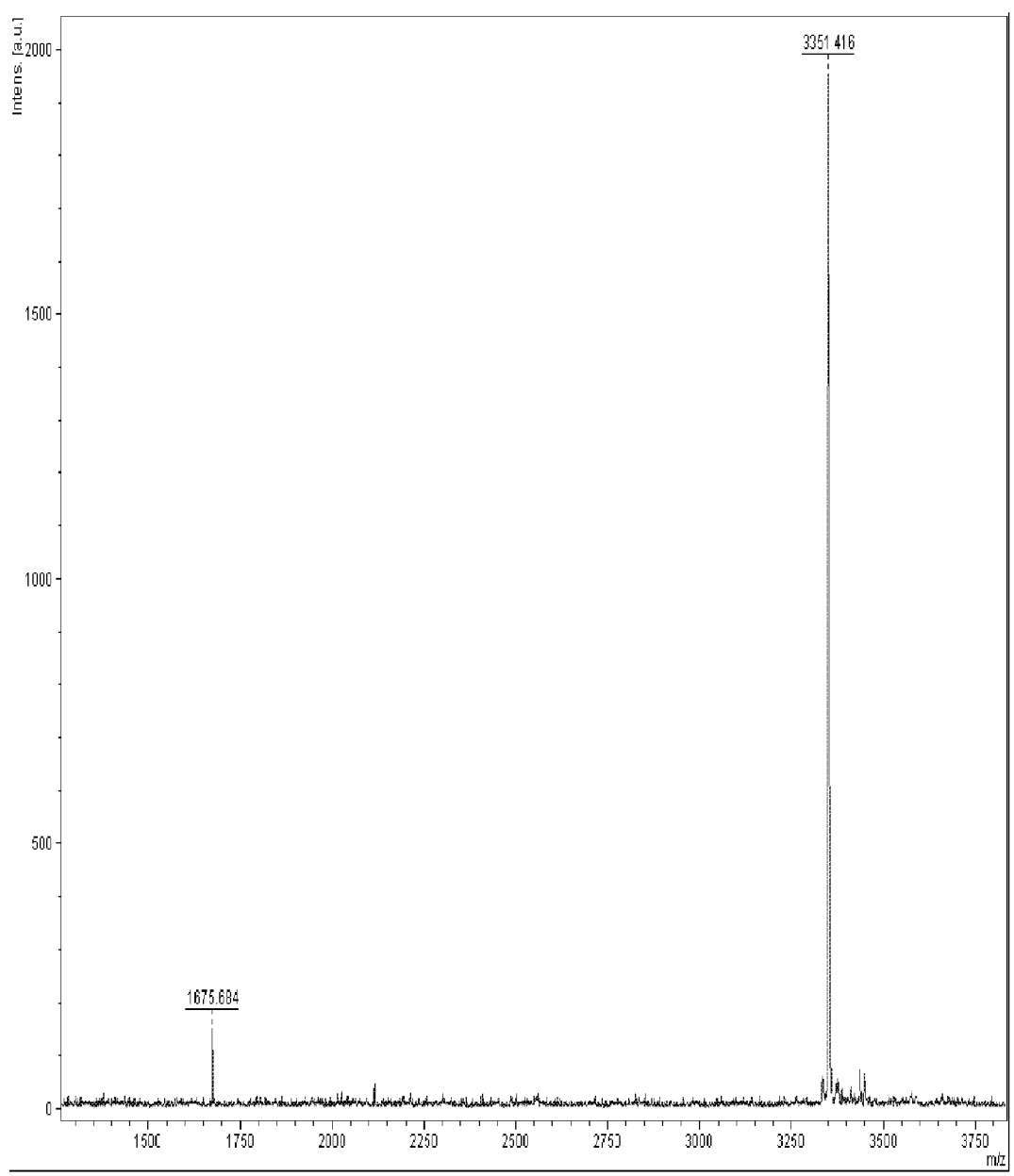
FIG. 1 shows MALDI-TOF data of a purified VIP analogue which illustrates the expected mass (within a reasonable tolerance) of both singly charged and doubly charged species of the analogue after chemical synthesis, cleavage from resin, and subsequent purification of the analogue through a C18 HPLC column.

Various terms relating to the methods and other aspects of the present invention are used throughout the specification and claims. Such terms are to be given their ordinary meaning in the art unless otherwise indicated. Other specifically defined terms are to be construed in a manner consistent with the definition provided herein.

As used in this specification and the appended claims, the singular forms "a," "an," and "the" include plural referents unless the content clearly dictates otherwise.

The term "about" as used herein when referring to a measurable value such as an amount, a temporal duration, and the like, is meant to encompass variations of ±20%, ±10%, ±5%, ±1%, or ±0.1% from the specified value, as such variations are appropriate to perform the disclosed methods.

The term "active state" refers to the conformation or set of conformations of a polypeptide that allows functional domain or domains of the polypeptide to associate or disassociate with another compound, macromolecule, or ligand. In some embodiments, the association or disassociation of the polypeptide with another compound, macromolecule, or ligand may propagate or inhibit a biologic signal.

The terms "amino acid" refer to a molecule containing both an amino group and a carboxyl group bound to a carbon which is designated the α-carbon. Suitable amino acids include, without limitation, both the D- and L-isomers of the naturally-occurring amino acids, as well as non-naturally occurring amino acids prepared by organic synthesis or other metabolic routes. in some embodiments, a single "amino acid" might have multiple sidechain moieties, as available per an extended aliphatic or aromatic backbone scaffold. Unless the context specifically indicates otherwise, the term amino acid, as used herein, is intended to include amino acid analogs.

The term "analog" refers to any polypeptide comprising at least one α-amino acid and at least one β-amino acid residue, wherein the polypeptide is structurally similar to a naturally occurring full-length protein and shares the biochemical or biological activity of the naturally occurring full-length protein upon which the analog is based. In some embodiments, an analog is any polypeptide comprising at least one β-amino acid residue, wherein the polypeptide is structurally similar to a naturally occurring full-length protein and shares the biochemical or biological activity of the naturally occurring full-length protein upon which the analog is based and wherein the addition of one or more β-amino acid residues constrains an alpha helical structure in the polypeptide. In some embodiments, an analog is any polypeptide comprising at least one β-amino acid residue, wherein the polypeptide is structurally similar to a naturally occurring full-length protein and shares the biochemical or biological activity of the naturally occurring full-length protein upon which the analog is based. In some embodiments, the non-natural amino acid residue is a monomer of an aliphatic polypeptide. In some embodiments the aliphatic analogs are chosen from oligoureas, azapeptides, pyrrolinones, α-aminoxy-peptides, and sugar-based peptides. In some embodiments, the composition comprises a non-natural β-amino acid. In some embodiments, the analog is a fragment of the full-length protein upon which the analog is based. In some embodiments, fragments are from about 5 to about 75 amino acids in length as compared to the naturally occurring, fully translated and fully processed protein sequences. In some embodiments, the analogs comprise a fragment of a naturally translated full-length protein that induces the biochemical or biological activity of a biological pathway of a subject at a level equivalent to or increased as compared to the activity induced by a naturally occurring full-length protein upon which the analog is derived. In some embodiments, the analog is a truncated polypeptide as compared to the full-length, naturally translated or naturally occurring polypeptide upon which the truncated polypeptide is derived. In some embodiments, the analog is a synthetic polypeptide, wherein at least one of the amino acid residues of the polypeptide comprises at least one non-natural side chain. In some embodiments, the analogs of the invention comprise at least one non-natural amino acid chosen from one of the following structures: aminoisobutyric acid, 3-Aminobutyric acid, and 2-hydroxy-4-(4-nitrophenyl)butyric acid. In some embodiments, the analog has a polypeptide backbone of identical length and similar homology to the polypeptides disclosed in Tables 1, 2, 3, and/or 4. In some embodiments, the analog is about 70%, 75%, 80%, 85%, 90%, 95%, 98%, or 99% homolgous to at least one of the polypeptides disclosed in Tables 1, 2, 3, and/or 4. In some embodiments, the analog is an agonist or antagonist of one or more of the following receptors: VPAC1, VPAC2, or PAC1. In some embodiments, the analog is a fragment of one of the polypeptides disclosed in Tables 1, 2, 3, and 4 and shares the same or improved biological or biochemical activity as compared to the biological or biochemical activity of the polypeptides disclosed in Tables 1, 2, 3, and/or 4 upon which the analog amino acid sequence is derived. In some embodiments, the analog is an agonist or antagonist of the receptor of the full-length, naturally translated or naturally occurring polypeptide upon which the amino acid sequence of the agonist or antagonist is derived. In some embodiments, the analog is an agonist or antagonist of the receptor of the polypeptides disclosed in Tables 1, 2, 3, and/or 4. In such embodiments, the amino acid sequence of the agonists or antagonists are derived from the amino acid sequence of the polypeptides disclosed in Tables 1, 2, 3, and/or 4. In some embodiments the analog of the present invention is modified by a bioactive lipid moiety on at least one amino acid residue of the analog. In such embodiments, the lipid moieties may be chosen from the following lipid molecules: LPA, progesterone, prostanoids, SIP, LPA, cannabinoids, 2-arachidonylglycerol. In some embodiments, the side chain or terminal end of the amino acid residues of the polypeptides disclosed in Tables 1, 2, 3, and/or 4 may be modified with the bioreactive lipid moieties. In some embodiments, the analogs of the present invention are derived from one of the following sequences:

```
                                          (SEQ ID NO: 6)
HSDGIFTDSYSRYRKQMAVKKYLAAVLGKRYKQRVKNK-NH2;

(SEQ ID NO: 5)
HSDGIFTDSYSRYRKQMAVKKYLAAVL-NH2;

(SEQ ID NO: 9)
HSDGTFTSELSRLRDSARLQRLLQGLV-NH2;

(SEQ ID NO: 1335)
HSDGTFTSDYSKYLDSRRAQDFVQWLMNT-NH2;

(SEQ ID NO: 7)
HADGVFTSDFSKLLGQLSAKKYLESLM-NH2
```

The term "α-amino acid" refers to any and all natural and unnatural α-amino acids and their respective residues (i.e., the form of the amino acid when incorporated into a polypeptide molecule), without limitation. In some embodiments, "α-amino acid" explicitly encompasses the conventional and well-known naturally occurring amino acids, as well as all synthetic variations, derivatives, and analogs thereof. In some embodiments, "α-amino acid" means alanine, arginine, asparagine, aspartic acid, cysteine, glutamine, glutamic acid, glycine, histidine, isoleucine, leucine, lysine, methionine, phenylalanine, proline, serine, threonine, tryptophan, tyrosine, and/or valine. In some embodiments, α-amino acids also include analogs such as N-methylated α-amino acids, hydroxylated α-amino acids, and aminoxy acids. In some embodiments, α-amino refers to include N-alkyl α-amino acids (such as N-methyl glycine), hydroxylysine, 3-hydroxyproline, 4-hydroxyproline, nor-valine, nor-leucine, and ornithine.

The terms "β-amino acid" and "β-amino acid residue" refer to any and all β-amino acids and their respective residues (i.e., the form of the amino acid when incorporated into a polypeptide molecule), without limitation. In some embodiments, the terms "β-amino acid" refers to those β-amino acids described in U.S. Pat. No. 6,060,585, issued May 9, 2000, incorporated herein by reference, and those described in allowed U.S. Pat. No. 6,683,154, issued Jan. 27, 2004; U.S. Pat. No. 6,710,186, issued Mar. 23, 2004; and U.S. Pat. No. 6,727,368, issued Apr. 27, 2004, all of which are incorporated herein by reference. Further still, cyclic imino carboxylic acids and gem-di-substituted cyclic imino carboxylic acids (both of which are a type of cyclically-constrained β-amino acid) may also be used in the invention. In some embodiments, the term "β-amino acid" refers to residues disclosed in U.S. Pat. No. 6,958,384, issued Oct. 25, 2005, incorporated herein by reference. Further still, these β-residues may also take the form of the gem-di-substituted cyclic amino acids disclosed in U.S. Pat. No. 6,710,186, incorporated herein by reference. In some embodiments, the terms "β-amino acid" refers to β-homo amino acids. In some embodiments the β-amino acids refers to the selection of an amino acid chosen from the following:

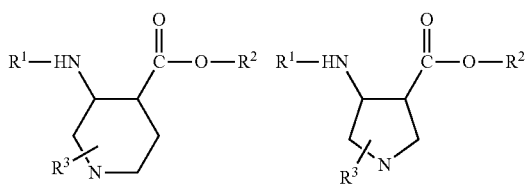

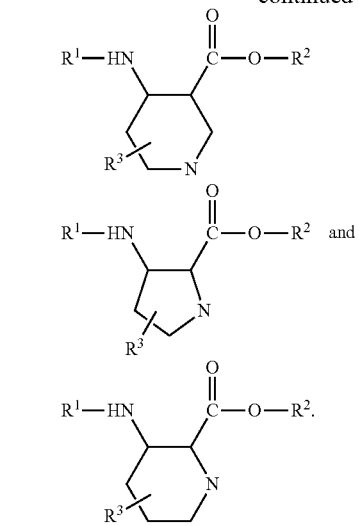

$R^1$ is selected from the group consisting hydrogen and an amino protecting group; $R^2$ is selected from the group consisting of hydrogen and a carboxy protecting group; and when $R^3$ is bonded to a carbon atom, $R^3$ is selected from the group consisting of hydrogen, hydroxy, linear or branched $C_1$-$C_6$-alkyl, alkenyl, or alkynyl; mono- or bicyclic aryl, mono- or bicyclic heteroaryl having up to 5 heteroatoms selected from N, O, and S; mono- or bicyclic aryl-$C_1$-$C_6$-alkyl, mono- or bicyclic heteroaryl-$C_1$-$C_6$-alkyl, —$(CH_2)_{n+1}$, —$OR^4$, —$(CH_2)_{n+1}$—$SR^4$, —$(CH_2)_{n+1}$—$S(=O)$—$CH_2$—$R^4$, —$(CH_2)_{n+1}$—$S(=O)_2$—$CH_2$—$R^4$, —$(CH_2)_{n+1}$—$NR^4R^4$, —$(CH_2)_{n+1}$—$NHC(=O)R^4$, —$(CH_2)_{n+1}$—$NHS(=O)_2$—$CH_2$—$R^4$, —$(CH_2)_{n+1}$—O—$(CH_2)_m$—$R^5$, —$(CH_2)_{n+1}$—S—$(CH_2)_m R^5$, —$(CH_2)_{n+1}$—$S(=O)$—$(CH_2)_m$—$R^5$, —$(CH_2)_{n+1}$—$S(=O)_2$—$(CH_2)_m$—$R^5$, —$(CH_2)_{n+1}$—NH—$(CH_2)_m$—$R^5$, —$(CH_2)_{n+1}$—N—{$(CH_2)_m$—$R^5$}$_2$, —$(CH_2)_{n+1}$—$NHC(=O)$—$(CH_2)_{n+1}$—$R^5$, and —$(CH_2)_{n+1}$—$NHS(=O)_2$—$(CH_2)_m$—$R^5$; wherein each $R^4$ is independently selected from the group consisting of hydrogen, $C_1$-$C_6$alkyl, alkenyl, or alkynyl; mono- or bicyclic aryl, mono- or bicyclic heteroaryl having up to S heteroatoms selected from N, O, and S; mono- or bicyclic aryl-$C_1$-$C_6$alkyl, mono- or bicyclic heteroaryl-$C_1$-$C_6$alkyl; and wherein $R^5$ is selected from the group consisting of hydroxy, $C_1$-$C_6$alkyloxy, aryloxy, heteroaryloxy, thio, $C_1$-$C_6$alkylthio, $C_1$-$C_6$alkylsulfinyl, $C_1$-$C_6$alkylsulfonyl, arylthio, arylsulfinyl, arylsulfonyl, heteroarylthio, heteroarylsulfinyl, heteroarylsulfonyl, amino, mono- or di-$C_1$-$C_6$alkylamino, mono- or diarylamino, mono- or diheteroarylamino, N-alkyl-N-arylamino, N-alkyl-N-heteroarylamino, N-aryl-N-heteroarylamino, aryl-$C_1$-$C_6$alkylamino, carboxylic acid, carboxamide, mono- or di-$C_1$-$C_6$alkylcarboxamide, mono- or diarylcarboxamide, mono- or diheteroarylcarboxamide, N-alkyl-N-arylcarboxamide, N-alkyl-N-heteroarylcarboxamide, N-aryl-N-heteroarylcarboxamide, sulfonic acid, sulfonamide, mono- or di-$C_1$-$C_6$alkylsulfonamide, mono- or diarylsulfonamide, mono- or diheteroarylsulfonamide, N-alkyl-N-arylsulfonamide, N-alkyl-N-heteroarylsulfonamide, N-aryl-N-heteroarylsulfonamide, urea; mono-di- or tri-substituted urea, wherein the subsitutent(s) is selected from the group consisting of $C_1$-$C_6$alkyl, aryl, heteroaryl; O-alkylurethane, O-arylurethane, and O-heteroarylurethane; and m is an integer of from 2-6 and n is an integer of from 0-6; and when $R^3$ is bonded to a nitrogen atom, $R^3$ is independently selected from the group consisting of those listed above for when $R^3$ is attached to a carbon atom, and further selected from the group consisting of —$S(=O)_2$—$CH_2$—$R^4$, —$C(=O)$—

$R^4$—S(=O)$_2$—(CH$_2$)$_m$R$^5$, and —C(=O)—(CH$_2$)$_{n+1}$—R$^5$; wherein R$^4$ and R$^5$ are as defined hereinabove, and m is an integer of from 2-6 and n is an integer of from 0-6; provided that when the β-amino acid is of formula R$^3$ is not hydrogen; racemic mixtures thereof, isolated or enriched enantiomers thereof; isolated or enriched diastereomers thereof; and salts thereof. In some embodiments the β-amino acids refers to the selection of an amino acid chosen from the following:

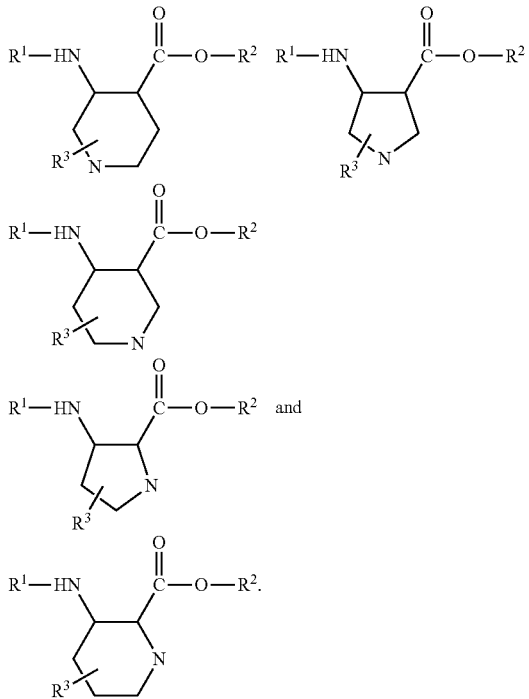

In some embodiments the β-amino acids refers to the following formula:

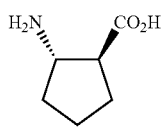

ACPC

In some embodiments the β-amino acids refers to the following formula:

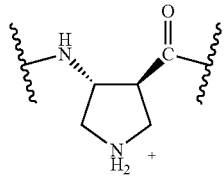

An APC residue within an undefined peptide chain, under neutral aqueous conditions (the ring N is protonated).

wherein the NH$_2$ and/or COOH groups are replaced with functional peptide bonds.

In some embodiments the term "β-amino acid" refers to:

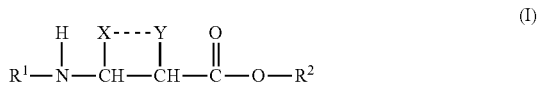

wherein X and Y combined, together with the carbon atoms to which they are bonded, define a substituted or unsubstituted C$_4$-C$_8$ cycloalkyl, cycloalkenyl or heterocyclic, ring having one or more nitrogen atoms as the sole heteroatom;
the substituents on carbon atoms of the rings being independently selected from the group consisting of linear or branched C$_1$-C$_6$-alkyl, alkenyl, or alkynyl; mono- or bicyclic aryl, mono- or bicyclic heteroaryl having up to 5 heteroatoms selected from N, O, and S; mono- or bicyclic aryl-C$_1$-C$_6$-alkyl, mono- or bicyclic heteroaryl-C$_1$-C$_6$-alkyl, —(CH$_2$)$_{n+1}$—OR$^4$, —(CH$_2$)$_{n+1}$—SR$^4$, —(CH$_2$)$_{n+1}$—S(=O)—CH$_2$—R$^4$, —(CH$_2$)$_{n+1}$—S(=O)$_2$—CH$_2$—R$^4$, —(CH$_2$)$_{n+1}$—NR$^4$R$^4$, —(CH$_2$)$_{n+1}$—NHC(=O)R$^4$, —(CH$_2$)$_{n+1}$—NHS(=O)$_2$—CH$_2$—R$^4$, —(CH$_2$)$_{n+1}$—O—(CH$_2$)$_{n+1}$—R$^5$, —(CH$_2$)$_{n+1}$—S(CH$_2$)$_m$—R$^5$, —(CH$_2$)$_m$—S(=O)—(CH$_2$)$_m$—R$^5$, —(CH$_2$)$_{n+1}$—S(=O)$_2$—(CH$_2$)$_m$—R$^5$, —(CH$_2$)$_{n+1}$—NH—(CH$_2$)$_m$—R$^5$, —(CH$_2$)$_{n+1}$—N—{(CH$_2$)$_m$—R$^5$}$_2$, —(CH$_2$)$_{n+1}$—NHC(=O)—(CH$_2$)$_{n+1}$—R$^5$, and —(CH$_2$)$_{n+1}$—NHS(=O)$_2$—(CH$_2$)$_m$—R$^5$;
wherein R$^4$ is independently selected from the group consisting of hydrogen, C$_1$-C$_6$-alkyl, alkenyl, or alkynyl; mono- or bicyclic aryl, mono- or bicyclic heteroaryl having up to 5 heteroatoms selected from N, O, and S; mono- or bicyclic aryl-C$_1$-C$_6$-alkyl, mono- or bicyclic heteroaryl-C$_1$-C$_6$-alkyl; and
wherein R$^5$ is selected from the group consisting of hydroxy, C$_1$-C$_6$alkyloxy, aryloxy, heteroaryloxy, thio, C$_1$-C$_6$-alkylthio, C$_1$-C$_6$alkylsulfinyl, C$_1$-C$_6$-alkylsulfonyl, arylthio, arylsulfinyl, arylsulfonyl, heteroarylthio, heteroarylsulfinyl, heteroarylsulfonyl, amino, mono- or di-C$_1$-C$_6$-alkylamino, mono- or diarylamino, mono- or diheteroarylamino, N-alkyl-N-arylamino, N-alkyl-N-heteroarylamino, N-aryl-N-heteroarylarnino, aryl-C$_1$-C$_6$-alkylamino, carboxylic acid, carboxamide, mono- or di-C$_1$-C$_6$-alkylcarboxamide, mono- or diarylcarboxamide, mono- or dihetemarylcarboxamide, N-alkyl-N-arylcarboxamide, N-alkyl-N-heteroarylcarboxamide, N-aryl-N-heteroarylcarboxamide, sulfortic acid, sulfonamide, mono- or di-C$_1$-C$_6$-alkylsulfonamide, mono- or diarylsulfonamide, mono- or diheteroarylsulfonamide, N-alkyl-N-aryl sulfonamide, N-alkyl-N-heteroarylsulfonamide, N-aryl-N-heteroarylsulfonamide, urea; mono-di- or tri-substituted urea, wherein the subsitutent(s) is selected from the group consisting of C$_1$-C$_6$alkyl, aryl, heteroaryl; O-alkylurethane, O-arylurethane, and O-heteroarylurethane; and
m is an integer of from 2-6 and n is an integer of from 0-6;
the substituents on heteroatoms of the ring being independently selected from the group consisting of —S(=O)$^2$—CH$_2$—R$^4$—C(=O)—R$^4$—S(=O)$_2$—(CH$_2$)$_m$—R$^5$, and —C(=O)—(CH$_2$)$_{n+1}$—R$^5$; wherein R$^4$ and R$^5$ are as defined hereinabove, and m is an integer of from 2-6 and n is an integer of from 0-6;
provided that when X & Y together with the carbons to which they are bonded define a five- or six-membered cycloalkyl or a five-membered heterocyclic ring having one nitrogen as the sole heteroatom, and the nitrogen is bonded to a carbon atom adjacent to the carboxy carbon of Formula I, the cycloalkyl or heterocyclic ring is substituted;

R$^1$ is selected from the group consisting hydrogen and an amino protecting group;

R$^2$ is selected from the group consisting of hydrogen and a carboxy protecting group;

racemic mixtures thereof; isolated or enriched enantiomers thereof; isolated or enriched diastereomers thereof;

and salts thereof.

In some embodiments the term "β-amino acid" refers to selection of an amino acid chosen from the following: β$^3$ or β$^2$. In some embodiments the term "β-amino acid" refers to selection of an amino acid chosen from the following:

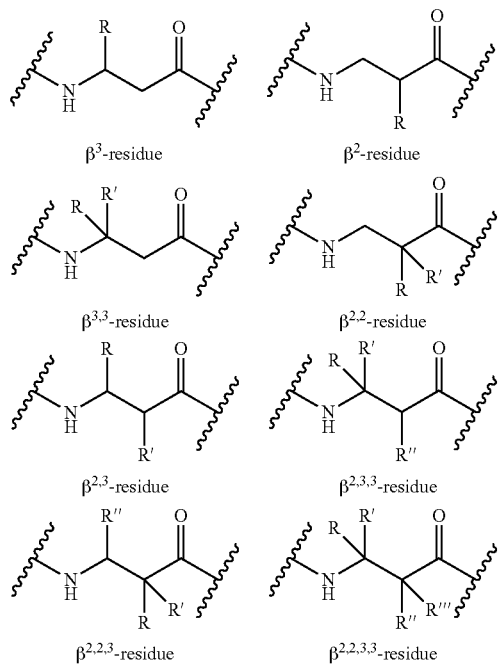

wherein R, R', R", and R'" are any substituent.

In some embodiments the term "β-amino acid" refers to selection of an amino acid chosen from the following:

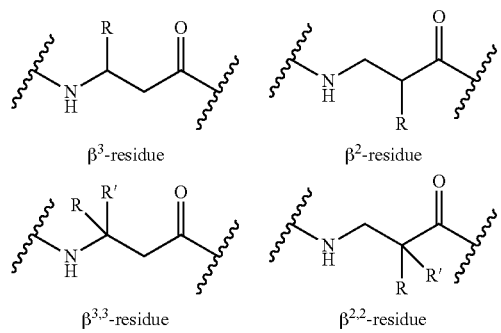

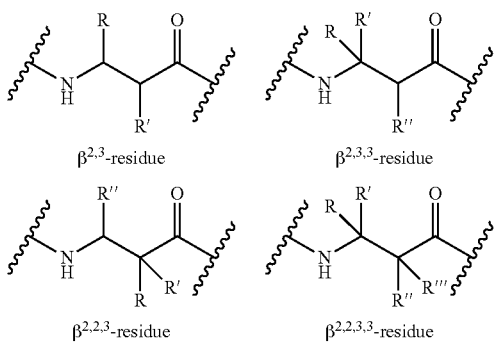

wherein R, R', R", and R'" is an amine, hydroxy, hydroxyl, carbonyl, H, =O, —OH, —COOH, —N, —CH$_3$, —CH$_2$—X, halo, aryl, arylalkoxy, arylalkyl, alkynyl, alkenyl, alkylene, alkyl, akyl-halo, arylamido, alkylheterocycle, alkylamino, alkylguanidino, alkanol, alkylcarboxy, cycloalkyl, heteroaryl, heteroarylalkyl, heteroarylalkoxy, or heterocyclyl;

wherein X is any substituent.

In some embodiments the term "β-amino acid" refers to selection of an amino acid chosen from the following:

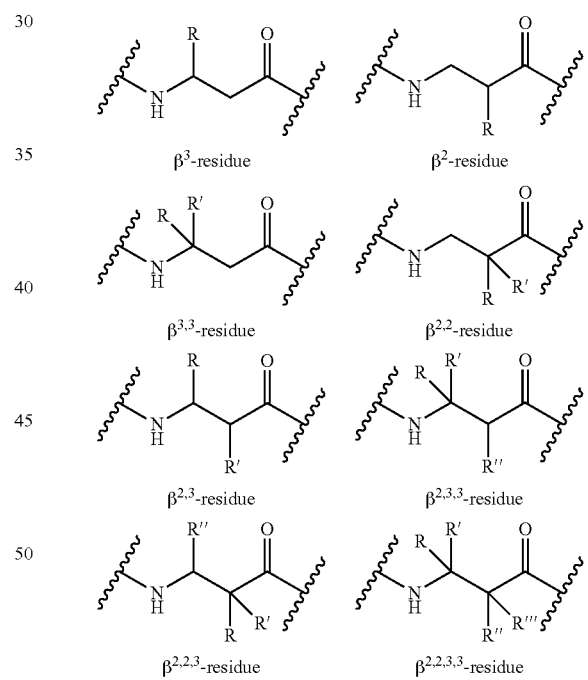

wherein R, R', R", and R'" are any substituent, provided that: (i) R is not O, N, or halo when the R is in a β$^3$-residue, (ii) R and R' are not O, N, or halo when the R and R' are in a β$^{3,3}$-residue; (iii) R is not O, N, or halo when the R is in a β$^{2,3}$-residue; (iv) R and R' are not O, N, or halo when the R and R' are in a β$^{2,3,3}$-residue; (v) R" is not O, N, or halo when the R" is in a β$^{2,2,3}$-residue; (vi) R and R' are not O, N, or halo when the R and R' are in a β$^{2,2,3,3}$-residue.

In some embodiments the term "β-amino acid" refers to selection of an amino acid chosen from the following:

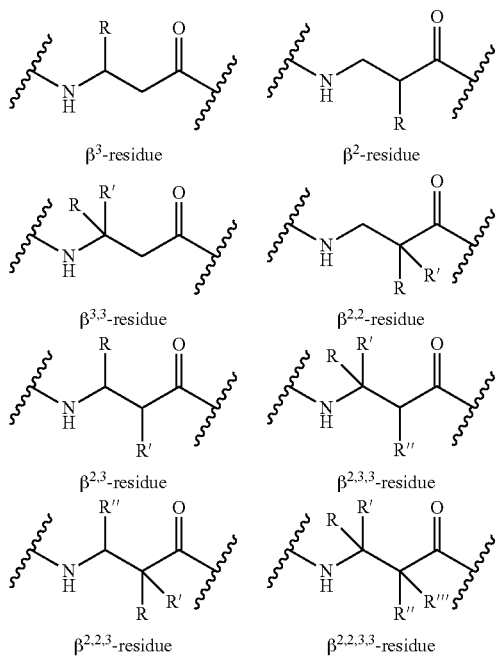

wherein R, R', R", and R''' is an amine, hydroxy, hydroxyl, carbonyl, H, =O, —OH, —COOH, —N, —CH$_3$, —CH$_2$—X, halo, aryl, arylalkoxy, arylalkyl, alkynyl, alkenyl, alkylene, alkyl, akyl-halo, arylamido, alkylheterocycle, alkylamino, alkylguanidino, alkanol, alkylcarboxy, cycloalkyl, heteroaryl, heteroarylalkyl, heteroarylalkoxy, or heterocyclyl;

wherein X is any substituent; provided that: (i) R is not O, N, or halo when the R is in a $\beta^3$-residue, (ii) R and R' are not O, N, or halo when the R and R' are in a $\beta^{3,3}$-residue; (iii) R is not O, N, or halo when the R is in a $\beta^{2,3}$-residue; (iv) R and R' are not O, N, or halo when the R and R' are in a $\beta^{2,3,3}$-residue; (v) R" is not O, N, or halo when the R" is in a $\beta^{2,2,3}$-residue; (vi) R and R' are not O, N, or halo when the R and R' are in a $\beta^{2,2,3,3}$-residue.

A "cyclic" beta-amino acid is acid is an amino acid of the following formula I:

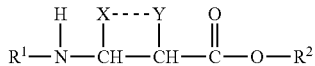

wherein X and Y combined, together with the carbon atoms to which they are bonded, define a substituted or unsubstituted C$_4$-C$_8$ cycloalkyl or cycloalkenyl group; wherein substituents on carbon atoms of the rings being independently selected from the group consisting of linear or branched C$_1$-C$_6$-alkyl, alkenyl, or alkynyl; mono- or bicyclic aryl, mono- or bicyclic heteroaryl having up to 5 heteroatoms selected from N, O, and S; mono- or bicyclic aryl-C$_1$-C$_6$-alkyl, mono- or bicyclic heteroaryl-C$_1$-C$_6$-alkyl, —(CH$_2$)$_{n+1}$—OR$_4$, —(CH 2)$_{n+1}$—SR$_4$, —(CH$_2$)$_{n+1}$—S(=O)—CH$_2$—R$_4$, —(CH$_2$)$_{n+1}$—S(=O)$_2$—CH$_2$—R$_4$, —(CH$_2$)$_{n+1}$—NR$_4$R$_4$, —(CH$_2$)$_{n+1}$—NHC(=O)R$_4$, —(CH$_2$)$_{n+1}$—NHS(=O)$_2$—CH$_2$—R$_4$, —(CH$_2$)$_{n+1}$—O—(CH$_2$)$_m$—R$^5$, —(CH$_2$)$_{n+1}$—S—(CH$_2$)$_m$—R$_5$, —(CH$_2$)$_{n+1}$—S(=O)—(CH$_2$)$_m$—R$_5$, —(CH$_2$)$_{n+1}$—S(=O)$_2$—(CH$_2$)$_m$—R$_5$, —(CH$_2$)$_{n+1}$—NH—(CH$_2$)$_m$—R$_5$, —(CH$_2$)$_{n+1}$—N—{(CH$_2$)$_m$—R$_5$}$_2$, —(CH$_2$)$_{n+1}$—NHC(=O)—(CH$_2$)$_{n+1}$—R$_5$, and —(CH$_2$)$_{n+1}$—NHS(=O)$_2$—(CH$_2$)$_m$—R$_5$; wherein R$_4$ is independently selected from the group consisting of hydrogen, C$_1$-C$_6$-alkyl, alkenyl, or alkynyl; mono- or bicyclic aryl, mono- or bicyclic heteroaryl having up to 5 heteroatoms selected from N, O, and S; mono- or bicyclic aryl-C$_1$-C$_6$-alkyl, mono- or bicyclic heteroaryl-C$_1$-C$_6$-alkyl; and wherein R$_5$ is selected from the group consisting of hydroxy, C$_1$-C$_6$-alkyloxy, aryloxy, heteroaryloxy, thio, C$_1$-C$_6$-alkylthio, C$_1$-C$_6$-alkylsulfinyl, C$_1$-C$_6$-alkylsulfonyl, arylthio, arylsulfinyl, arylsulfonyl, heteroarylthio, heteroarylsulfinyl, heteroarylsulfonyl, amino, mono- or di-C$_1$-C$_6$-alkylamino, mono- or diarylamino, mono- or diheteroarylamino, N-alkyl-N-arylamino, N-alkyl-N-heteroarylamino, N-aryl-N-heteroarylamino, aryl-C$_1$-C$_6$-alkylamino, carboxylic acid, carboxamide, mono- or di-C$_1$-C$_6$-alkylcarboxamide, mono- or diarylcarboxamide, mono- or diheteroarylcarboxamide, N-alkyl-N-arylcarboxamide, N-alkyl-N-heteroarylcarboxamide, N-aryl-N-heteroarylcarboxamide, sulfonic acid, sulfonamide, mono- or di-C$_1$-C$_6$-alkylsulfonamide, mono- or diarylsulfonamide, mono- or diheteroarylsulfonamide, N-alkyl-N-arylsulfonamide, N-alkyl-N-heteroarylsulfonamide, N-aryl-N-heteroarylsulfonamide, urea; mono-di- or tri-substituted urea, wherein the substituent(s) is selected from the group consisting of C$_1$-C$_6$-alkyl, aryl, heteroaryl; O-alkylurethane, O-arylurethane, and O-heteroarylurethane; and m is an integer of from 2-6 and n is an integer of from 0-6; the substituents on heteroatoms of the ring being independently selected from the group consisting of —S(=O)$_2$*CH$_2$—R$_4$—C(=O)—R$_4$—S(=O)$_2$—(CH$_2$)$_m$—R$_5$, and —C(=O)—(CH$_2$)$_{n+1}$—R$_5$; wherein R$_4$ and R$_5$ are as defined hereinabove, and m is an integer of from 2-6 and n is an integer between 0 and 6; provided that when X and Y together with the carbons to which they are bonded define a five- or six-membered cycloalkyl or a five-membered heterocyclic ring having one nitrogen as the sole heteroatom, and the nitrogen is bonded to a carbon atom adjacent to the carboxy carbon of Formula I, the cycloalkyl or heterocyclic ring is substituted; R$_1$ is selected from the group consisting hydrogen and an amino protecting group; R$_2$ is selected from the group consisting of hydrogen and a carboxy protecting group; racemic mixtures thereof, isolated or enriched enantiomers thereof; isolated or enriched diastereomers thereof; and salts thereof.

A "heterocyclic" beta-amino acid is an amino acid of formula I, wherein X and Y combined, together with the carbon atoms to which they are bonded, define a substituted or unsubstituted C$_4$-C$_8$ cyclically or cycloalkenyl group having one or more nitrogen, oxygen or sulfur atoms as a heteroatom(s) within the cycloakyl or cycloalkenyl group; wherein substituents on carbon atoms of the cycloakyl or cycloalkenyl rings being independently selected from the group consisting of linear or branched C$_1$-C$_6$-alkyl, alkenyl, or alkynyl; mono- or bicyclic aryl, mono- or bicyclic heteroaryl having up to 5 heteroatoms selected from N, O, and S; mono- or bicyclic aryl-C$_1$-C$_6$-alkyl, mono- or bicyclic heteroaryl-C$_1$-C$_6$-alkyl, —(CH 2)$_{n+1}$—OR$_4$, —(CH 2)$_{n+1}$—SR$_4$, —(CH$_2$)$_{n+1}$—S(=O)—CH$_2$—R$_4$, —(CH$_2$)$_{n+1}$—S(=O)$_2$—CH$_2$—R$_4$, —(CH$_2$)$_{n+1}$—NR$_4$R$_4$, —(CH$_2$)$_{n+1}$—NHC(=O)R$_4$, —(CH$_2$)$_{n+1}$—NHS(=O)$_2$—CH$_2$—R$_4$, —(CH$_2$)$_{n+1}$—O—(CH$_2$)$_m$—R$_5$, —(CH$_2$)$_{n+1}$—S—(CH$_2$)$_m$—R$_5$, —(CH$_2$)$_{n+1}$—S(=O)(CH$_2$)$_m$—R$_5$, —(CH$_2$)$_{n+1}$—S(=O)$_2$—(CH$_2$)$_m$—R$_5$, —(CH$_2$)$_{n+1}$—NH(CH$_2$)$_m$—R$_5$, —(CH$_2$)$_{n+1}$—N—{(CH$_2$)$_m$—R$_5$}$_2$, —(CH$_2$)$_{n+1}$—NHC(=O)—(CH$_2$)$_{n+1}$—R$_5$, and —(CH$_2$)$_{n+1}$—NHS(=O)$_2$—(CH$_2$)$_m$—R$_5$; wherein R$_4$ is independently selected from the group consisting of hydrogen, C$_1$-C$_6$-alkyl, alkenyl, or alkynyl; mono- or bicyclic aryl, mono- or bicyclic heteroaryl having up to 5 heteroatoms selected from N, O, and S; mono- or bicyclic aryl-$C_1$-$C_6$-alkyl, mono- or bicyclic heteroaryl-$C_1$-$C_6$-alkyl; and wherein $R_5$ is selected from the group consisting of hydroxy, $C_1$-$C_6$-alkyloxy, aryloxy, heteroaryloxy, thio, $C_1$-$C_6$-alkylthio, $C_1$-$C_6$-alkylsulfinyl, $C_1$-$C_6$-alkylsulfonyl, arylthio, arylsulfinyl, arylsulfonyl, heteroarylthio, heteroarylsulfinyl, heteroarylsulfonyl, amino, mono- or di-$C_1$-$C_6$-alkylamino, mono- or diarylamino, mono- or diheteroarylamino, N-alkyl-N-arylamino, N-alkyl-N-heteroarylamino, N-aryl-N-heteroarylamino, aryl-$C_1$-$C_6$-alkylamino, carboxylic acid, carboxamide, mono- or di-$C_1$-$C_6$-alkylcarboxamide, mono- or diarylcarboxamide, mono- or diheteroarylcarboxamide, N-alkyl-N-arylcarboxamide, N-alkyl-N-heteroarylcarboxamide, N-aryl-N-heteroarylcarboxamide, sulfonic acid, sulfonamide, mono- or di-$C_1$-$C_6$-alkylsulfonamide, mono- or diarylsulfonamide, mono- or diheteroarylsulfonamide, N-alkyl-N-arylsulfonamide, N-alkyl-N-heteroarylsulfonamide, N-aryl-N-heteroarylsulfonamide, urea; mono-di- or tri-substituted urea, wherein the subsitutent(s) is selected from the group consisting of $C_1$-$C_6$-alkyl, aryl, heteroaryl; O-alkylurethane, O-arylurethane, and O-heteroarylurethane; and m is an integer of from 2-6 and n is an integer of from 0-6; the substituents on heteroatoms of the ring being independently selected from the group consisting of —S(=O)$_2$—CH$_2$—$R_4$—C(=O)—$R_4$—S(=O)$_2$—(CH$_2$)$_m$—$R_5$, and —C(=O)—(CH$_2$)$_{n+1}$—$R_5$; wherein $R_4$ and $R_5$ are as defined hereinabove, and m is an integer of from 2-6 and n is an integer between 0 and 6; provided that when X and Y together with the carbons to which they are bonded define a five- or six-membered cycloalkyl or a five-membered heterocyclic ring having one nitrogen as the sole heteroatom, and the nitrogen is bonded to a carbon atom adjacent to the carboxy carbon of Formula I, the cycloalkyl or heterocyclic ring is substituted; $R_1$ is selected from the group consisting hydrogen and an amino protecting group; $R_2$ is selected from the group consisting of hydrogen and a carboxy protecting group; racemic mixtures thereof, isolated or enriched enantiomers thereof; isolated or enriched diastereomers thereof; and salts thereof.

In some embodiments, at least one of the β-amino acid residues in the analog is replaced with at least one β-amino acid residue that is cyclically constrained via a ring encompassing its $β^2$ and $β^3$ carbon atoms. In another embodiment of the invention, most or all of the inserted β-amino acid residues are cyclically constrained. In another version of the invention, at least one of the β-amino acid residues is unsubstituted at its $β^2$ and $β^3$ carbon atoms. Alternatively, all of the β-amino acid residues may be substituted at their $β^2$ and $β^3$ carbon atoms (with linear, branched or cyclic substituents). In some embodiments, the cyclic substituents of the claimed invention comprise side chains that are covalently bonded to the side chains of other contiguous amino acids. In some embodiments, the cyclic substituents of the claimed invention comprise side chains that are covalently bonded to the side chains of other non-contiguous amino acids. In some embodiments the cyclic substituents of the claimed invention do not include side chains that are covalently bonded to the side chains of other contiguous or non-contiguous amino acids. In some embodiments the terms beta-3 or beta-2 amino acid refers to β3-homo β2-homo amino acids.

A "conservative amino acid substitution" is one in which the amino acid residue is replaced with an amino acid residue having a similar side chain. Families of amino acid residues having similar side chains have been defined in the art. These families include amino acids with basic side chains (e.g., K, R, H), acidic side chains (e.g., D, E), uncharged polar side chains (e.g., G, N, Q, S, T, Y, C, H), nonpolar side chains (e.g., G, A, V, L, I, P, F, M, W), beta-branched side chains (e.g., T, V, I) and aromatic side chains (e.g., Y, F, W, H). Thus, a predicted nonessential amino acid residue in a VIP analog, for example, replaced with another amino acid residue from the same side chain family. Other examples of acceptable substitutions are substitutions based on isosteric considerations (e.g. norleucine for methionine) or other properties (e.g. 2-thienylalanine for phenylalanine).

As used herein, the term "derived from" in the context of the relationship between a chemical structure or amino acid sequence and a related chemical structure or related amino acid sequence describes a chemical structure or amino acid sequence that may be homologous to or structurally similar to the related chemical structure or related amino acid sequence.

As used herein, the term "inflammatory disease" refers to any disease, condition, or ailment that results from an immune response or a pathogen infection, which in some instances may be characterized by one or more of pain, swelling, and redness of a tissue types. In some embodiments, inflammatory disease refers to rheumatoid arthritis, Crohn's disease, sepsis, ulcerative colitis, irritable bowel disease, chronic irritable bowel syndrome, and allergies such as allergic rhinitis.

A "non-essential" amino acid residue is a residue that can be altered from the wild-type sequence of a polypeptide (e.g., a short domain of VIP) without abolishing or substantially altering its essential biological or biochemical activity (e.g., receptor binding or activation). An "essential" amino acid residue is a residue that, when altered from the wild-type sequence of the polypeptide, results in abolishing or substantially abolishing the polypeptide's essential biological or biochemical activity.

A "non-natural side chain" is a modified or synthetic chain of atoms joined by covalent bond to the α-carbon atom, β-carbon atom, or γ-carbon atom which does not make up the backbone of the polypeptide chain of amino acids. The natural side chain, or R group, of alanine is a methyl group. In some embodiments, the non-natural side chain of the composition is a methyl group in which on e or more of the hydrogen atoms is replaced by a deuterium atom.

The term "polypeptide" encompasses two or more naturally or non-naturally-occurring amino acids joined by a covalent bond (e.g., an amide bond). Polypeptides as described herein include full-length proteins (e.g., fully processed pro-proteins or full-length synthetic polypeptides) as well as shorter amino acid sequences (e.g., fragments of naturally-occurring proteins or synthetic polypeptide fragments).

The term "salt" refers to acidic salts formed with inorganic and/or organic acids, as well as basic salts formed with inorganic and/or organic bases. Examples of these acids and bases are well known to those of ordinary skill in the art. Such acid addition salts will normally be pharmaceutically acceptable although salts of non-pharmaceutically acceptable acids may be of utility in the preparation and purification of the compound in question. Salts include those formed from hydrochloric, hydrobromic, sulphuric, phosphoric, citric, tartaric, lactic, pyruvic, acetic, succinic, fumaric, maleic, methanesulphonic and benzenesulphonic acids.

In some embodiments, salts of the compositions comprising either a secretin or VIP analog may be formed by reacting the free base, or a salt, enantiomer or racemate thereof, with one or more equivalents of the appropriate acid. In some embodiments, pharmaceutical acceptable salts of the present invention refer to analogs having at least one basic group or at least one basic radical. In some embodiments, pharmaceutical acceptable salts of the present invention comprise a free amino group, a free guanidino group, a pyrazinyl radical, or a pyridyl radical that forms acid addition salts. In some embodiments, the pharmaceutical acceptable salts of the present invention refer to analogs that are acid addition salts of the subject compounds with (for example) inorganic acids, such as hydrochloric acid, sulfuric acid or a phosphoric acid, or with suitable organic carboxylic or sulfonic acids, for example aliphatic mono- or di-carboxylic acids, such as trifluoroacetic acid, acetic acid, propionic acid, glycolic acid, succinic acid, maleic acid, fumaric acid, hydroxymaleic acid, malic acid, tartaric acid, citric acid or oxalic acid, or amino acids such as arginine or lysine, aromatic carboxylic acids, such as benzoic acid, 2-phenoxy-benzoic acid, 2-acetoxybenzoic acid, salicylic acid, 4-aminosalicylic acid, aromatic-aliphatic carboxylic acids, such as mandelic acid or cinnamic acid, heteroaromatic carboxylic acids, such as nicotinic acid or isonicotinic acid, aliphatic sulfonic acids, such as methane-, ethane- or 2-hydroxyethane-sulfonic acid, or aromatic sulfonic acids, for example benzene-, p-toluene- or naphthalene-2-sulfonic acid. When several basic groups are present mono- or poly-acid addition salts may be formed. The reaction may be carried out in a solvent or medium in which the salt is insoluble or in a solvent in which the salt is soluble, for example, water, dioxane, ethanol, tetrahydrofuran or diethyl ether, or a mixture of solvents, which may be removed in vacuo or by freeze drying. The reaction may also be a metathetical process or it may be carried out on an ion exchange resin. In some embodiments, the salts may be those that are physiologically tolerated by a patient. Salts according to the present invention may be found in their anhydrous form or as in hydrated crystalline form (i.e., complexed or crystallized with one or more molecules of water).

The term "subject" is used throughout the specification to describe an animal to whom treatment with the compositions according to the present invention is provided or administered. For treatment of those conditions which are specific for a specific subject, such as a human being, the term "patient" may be interchangeably used. In some instances in the description of the present invention, the term "patient" will refer to human patients. In some embodiments, the subject may be a mammal to whom the present invention is provided or administered. In some embodiments, the subject may be a non-human animal to whom the present invention is provided or administered.

The term "soluble" or "water soluble" refers to solubility that is higher than 1/100,000 (mg/ml). The solubility of a substance, or solute, is the maximum mass of that substance that can be dissolved completely in a specified mass of the solvent, such as water. "Practically insoluble" or "insoluble," on the other hand, refers to an aqueous solubility that is 1/10,000 (mg/ml) or less. Water soluble or soluble substances include, for example, polyethylene glycol. In some embodiments, the polypeptide of the claimed invention may be bound by polyethylene glycol to better solubilize the composition comprising the peptide.

The terms "treating" and "to treat", mean to alleviate symptoms, eliminate the causation either on a temporary or permanent basis, or to prevent or slow the appearance of symptoms. The term "treatment" includes alleviation, elimination of causation (temporary or permanent) of, or prevention of symptoms and disorders associated with any condition. The treatment may be a pre-treatment as well as a treatment at the onset of symptoms.

"Effective amount" refers to an amount of a compound, material, or composition, as described herein effective to achieve a particular biological result such as, but not limited to, biological results disclosed, described, or exemplified herein. Such results may include, but are not limited to, the effective reduction of symptoms associated with any of the disease states mentioned herein, as determined by any means suitable in the art. The effective amount of the composition may be dependent on any number of variables, including without limitation, the species, breed, size, height, weight, age, overall health of the subject, the type of formulation, the mode or manner or administration, the type and/or severity of the particular condition being treated, or the need to modulate the activity of the molecular pathway induced by association of the analog to its receptor. The appropriate effective amount can be routinely determined by those of skill in the art using routine optimization techniques and the skilled and informed judgment of the practitioner and other factors evident to those skilled in the art. A therapeutically effective dose of the analogs described herein may provide partial or complete biological activity as compared to the biological activity induced by the wild-type or naturally occurring polypeptides upon which the analogs are derived. A therapeutically effective dose of the analogs described herein may provide a sustained biochemical or biological affect and/or an increased resistance to degradation when placed in solution as compared with the normal affect observed when the naturally occurring and fully processed translated protein is administered to the same subject.

The term "fragment" refers to any analog of a naturally occurring polypeptide disclosed herein that comprises at least 4 amino acids identical to the naturally occurring polypeptide upon which the analog is based. The term "functional fragment" refers to any fragment of any analog of a naturally occurring polypeptide disclosed herein that comprises at least 4 amino acids identical to the naturally occurring polypeptide upon which the analog is based and shares the function of the naturally occurring polypeptide upon which the analog is based. In some embodiments, the compositions or pharmaceutical composition comprises an analog comprising at least one β-amino acid. wherein the analog is a fragment of VIP, a secretin family member, an interleukin, or any of the polypeptides disclosed in the instant application. In some embodiments, the compositions or pharmaceutical composition comprises an analog comprising at least one β-amino acid, wherein the analog is a fragment of VIP, a secretin family member, an interleukin, or any of the polypeptides disclosed in the instant application and wherein the fragment shares at least 4 contiguous amino acid residues with the naturally occurring polypeptide upon which the analog is based and wherein the fragment retains the biological activity of the naturally occurring polypeptide upon which the analog is based. In some embodiments, the VIP analog is a fragment that comprises between about 1 to about 27 amino acids of the naturally occurring VIP sequence. In some embodiments, the VIP analog is a fragment that comprises between about 1 to about 26 amino acids of the naturally occurring VIP sequence. In some embodiments, the VIP analog is a fragment that comprises between about 1 to about 25 amino acids of the naturally occurring VIP sequence. In some embodiments, the VIP analog is a fragment that comprises between about 1 to about 24 amino acids of the naturally occurring VIP sequence. In some embodiments, the VIP analog is a fragment that comprises between about 1 to about 23 amino acids of the naturally occurring VIP sequence. In some embodiments, the VIP analog is a fragment that comprises between about 1 to about 22 amino acids of the naturally occurring VIP sequence. In some embodiments, the VIP analog is a fragment that comprises between about 1 to about 21 amino acids of the naturally occurring VIP sequence. In some embodiments, the VIP analog is a fragment that comprises between about 1 to about 20 amino acids of the naturally occurring VIP sequence. In some embodiments, the VIP analog is a fragment that comprises between about 1 to about 19 amino acids of the naturally occurring VIP sequence. In some embodiments, the VIP analog is a fragment that comprises between about 1 to about 18 amino acids of the naturally occurring VIP sequence. In some embodiments, the VIP analog is a fragment that comprises between about 1 to about 19 amino acids of the naturally occurring VIP sequence. In some embodiments, the VIP analog is a fragment that comprises between about 1 to about 17 amino acids of the naturally occurring VIP sequence. In some embodiments, the VIP analog is a fragment that comprises between about 1 to about 16 amino acids of the naturally occurring VIP sequence. In some embodiments, the VIP analog is a fragment that comprises between about 1 to about 15 amino acids of the naturally occurring VIP sequence. In some embodiments, the VIP analog is a fragment that comprises between about 1 to about 14 amino acids of the naturally occurring VIP sequence. In some embodiments, the VIP analog is a fragment that comprises between about 1 to about 13 amino acids of the naturally occurring VIP sequence. In some embodiments, the VIP analog is a fragment that comprises between about 1 to about 12 amino acids of the naturally occurring VIP sequence. In some embodiments, the VIP analog is a fragment that comprises between about 1 to about 11 amino acids of the naturally occurring VIP sequence. In some embodiments, the VIP analog is a fragment that comprises between about 1 to about 10 amino acids of the naturally occurring VIP sequence. In some embodiments, the VIP analog is a fragment that comprises between about 1 to about 9 amino acids of the naturally occurring VIP sequence. In some embodiments, the VIP analog is a fragment of VIP that comprises between about 1 to about 8 amino acids of the naturally occurring VIP sequence. In some embodiments, the VIP analog is a fragment that comprises between about 1 to about 7 amino acids of the naturally occurring VIP sequence. In some embodiments, the VIP analog is a fragment that comprises between about 1 to about 6 amino acids of the naturally occurring VIP sequence. In some embodiments, the VIP analog is a fragment that comprises between about 1 to about 5 amino acids of the naturally occurring VIP sequence. In some embodiments, the VIP analog is a fragment that comprises between about 1 to about 4 amino acids of the naturally occurring VIP sequence. In some embodiments, the analog is modified with at least one PEG molecule on at least one of the non-natural amino acids.

The term "halo" or "halogen" refers to fluorine, chlorine, bromine or iodine or a radical thereof. The term "alkyl" refers to a hydrocarbon chain that is a straight chain or branched chain, containing the indicated number of carbon atoms. For example, $C_1$-$C_{10}$ indicates that the group has from 1 to 10 (inclusive) carbon atoms in it. In the absence of any numerical designation, "alkyl" is a chain (straight or branched) having 1 to 20 (inclusive) carbon atoms in it. In some embodiments the alkyl group is chosen from: $C_1$-$C_{10}$, $C_2$-$C_{10}$, $C_3$-$C_{10}$, $C_4$-$C_{10}$, $C_5$-$C_{10}$, $C_6$-$C_{10}$, $C_7$-$C_{10}$, $C_8$-$C_{10}$, $C_9$-$C_{10}$, $C_{10}$-$C_{10}$, $C_1$-$C_2$, $C_1$-$C_3$, $C_1$-$C_4$, $C_1$-$C_5$, $C_1$-$C_6$, $C_1$-$C_7$, $C_1$-$C_8$, or $C_1$-$C_9$, The term "alkylene" refers to a divalent alkyl (i.e., —R—).

The term "alkenyl" refers to a hydrocarbon chain that is a straight chain or branched chain having one or more carbon-carbon double bonds. The alkenyl moiety contains the indicated number of carbon atoms. For example, $C_2$-$C_{10}$ indicates that the group has from 2 to 10 (inclusive) carbon atoms in it. The term "lower alkenyl" refers to a $C_2$-$C_6$ alkenyl chain. In the absence of any numerical designation, "alkenyl" is a chain (straight or branched) having 2 to 20 (inclusive) carbon atoms in it.

The term "alkynyl" refers to a hydrocarbon chain that is a straight chain or branched chain having one or more carbon-carbon triple bonds. The alkynyl moiety contains the indicated number of carbon atoms. For example, $C_2$-$C_{10}$ indicates that the group has from 2 to 10 (inclusive) carbon atoms in it. The term "lower alkynyl" refers to a $C_2$-$C_6$ alkynyl chain. In the absence of any numerical designation, "alkynyl" is a chain (straight or branched) having about 2 to about 20 (inclusive) carbon atoms in it.

The term "aryl" refers to an aromatic ring system. In some embodiments, the aryl group of the analog include substituents, wherein 0, 1, 2, 3, 4, 5, 6, 7, 8, 9, or 10 atoms of each ring are substituted by a substituent. In some embodiments, the aryl group refers to a 6-carbon monocyclic or 10-carbon bicyclic aromatic ring system wherein 0, 1, 2, 3, or 4 atoms of each ring are substituted by a substituent. Examples of aryl groups include phenyl, naphthyl and the like. The term "arylalkyl" or the term "aralkyl" refers to alkyl substituted with an aryl. The term "arylalkoxy" refers to an alkoxy substituted with aryl. "Arylalkyl" refers to an aryl group, as defined above, wherein one of the aryl group's hydrogen atoms has been replaced with an alkyl group, as defined above. Representative examples of an arylalkyl group include, but are not limited to, 2-methylphenyl, 3-methylphenyl, 4-methylphenyl, 2-ethylphenyl, 3-ethylphenyl, 4-ethylphenyl, 2-propylphenyl, 3-propylphenyl, 4-propylphenyl, 2-butylphenyl, 3-butylphenyl, 4-butylphenyl, 2-pentylphenyl, 3-pentylphenyl, 4-pentylphenyl, 2-isopropylphenyl, 3-isopropylphenyl, 4-isopropylphenyl, 2-isobutylphenyl, 3-isobutylphenyl, 4-isobutylphenyl, 2-sec-butylphenyl, 3-sec-butylphenyl, 4-sec-butylphenyl, 2-t-butylphenyl, 3-t-butylphenyl and 4-t-butylphenyl.

"Arylamido" refers to an aryl group, as defined above, wherein one of the aryl group's hydrogen atoms has been replaced with one or more —C(O)NH$_2$ groups. Representative examples of an arylamido group include 2-C(O)NH$_2$-phenyl, 3-C(O)NH$_2$-phenyl, 4-C(O)NH$_2$-phenyl, 2-C(O)NH$_2$-pyridyl, 3-C(O)NH$_2$-pyridyl, and 4-C(O)NH$_2$-pyridyl.

"Alkylheterocycle" refers to an alkyl group, as defined above, wherein one of the alkyl group's hydrogen atoms has been replaced with a heterocycle. Representative examples of an alkylheterocyclo group include, but are not limited to, —CH$_2$CH$_2$-morpholine, —CH$_2$CH$_2$piperidine, —CH$_2$CH$_2$CH$_2$-morpholine, and —CH$_2$CH$_2$CH$_2$-imidazole.

"Alkylamido" refers to an alkyl group, as defined above, wherein one of the alkyl group's hydrogen atoms has been replaced with a —C(O)NH$_2$ group. Representative examples of an alkylamido group include, but are not limited to, —CH$_2$C(O)NH$_2$, —CH$_2$CH$_2$C(O)NH$_2$, —CH$_2$CH$_2$CH$_2$C(O)NH$_2$, —CH$_2$CH$_2$CH$_2$C(O)NH$_2$, —CH$_2$CH$_2$CH$_2$CH$_2$C(O)NH$_2$, —CH$_2$CH(C(O)NH$_2$)CH$_3$, —CH$_2$CH(C(O)NH$_2$)CH$_2$CH$_3$, —CH(C(O)NH$_2$)

CH$_2$CH$_3$, —C(CH$_3$)$_2$CH$_2$C(O)NH$_2$, —CH$_2$CH$_2$NHC(O)CH$_3$, —CH$_2$CH$_2$NHC(O)CH$_2$CH$_3$, and —CH$_2$CH$_2$NHC(O)CH═CH$_2$.

"Alkylamino" refers to an alkyl group, as defined above, wherein one of the alkyl group's hydrogen atoms has been replaced with a —NH$_2$ group. Representative examples of an alkylamido group include, but are not limited to —CH$_2$NH$_2$, CH$_2$CH$_2$NH$_2$, CH$_2$CH$_2$CH$_2$NH$_2$, —CH$_2$CH$_2$CH$_2$CH$_2$NH$_2$, —CH$_2$CH$_2$CH$_2$CH$_2$CH$_2$NH$_2$.

"Alkylguanidino" refers to an alkyl group, as defined above, wherein one of the alkyl group's hydrogen atoms has been replaced with a —NH$_2$(C═NH)NH$_2$ group. Representative examples of an alkylamido group include, but are not limited to —CH$_2$NH$_2$(C═NH)NH$_2$, CH$_2$CH$_2$NH$_2$(C═NH)NH$_2$, CH$_2$CH$_2$CH$_2$NH$_2$(C═NH)NH$_2$, —CH$_2$CH$_2$CH$_2$CH$_2$NH$_2$(C═NH)NH$_2$, —CH$_2$CH$_2$CH$_2$CH$_2$CH$_2$NH$_2$(C═NH)NH$_2$. In some embodiments alkyl units can be found on the N atom(s) of the alkylamino or alkylguanidino groups (for example, —CH$_2$NH(CH$_3$), CH$_2$N(CH$_3$)$_2$).

"Alkanol" refers to an alkyl group, as defined above, wherein one of the alkyl group's hydrogen atoms has been replaced with a hydroxyl group. Representative examples of an alkanol group include, but are not limited to, —CH$_2$OH, —CH$_2$CH$_2$OH, —CH$_2$CH$_2$CH$_2$OH, —CH$_2$CH$_2$CH$_2$CH$_2$OH, —CH$_2$CH$_2$CH$_2$CH$_2$CH$_2$OH, —CH$_2$CH(OH)CH$_3$, —CH$_2$CH(OH)CH$_2$CH$_3$, —CH(OH)CH$_3$ and —C(CH$_3$)$_2$CH$_2$OH.

"Alkylcarboxy" refers to an alkyl group, as defined above, wherein one of the alkyl group's hydrogen atoms has been replaced with a —COOH group. Representative examples of an alkylcarboxy group include, but are not limited to, —CH$_2$COOH, —CH$_2$CH$_2$COOH, —CH$_2$CH$_2$CH$_2$COOH, —CH$_2$CH$_2$CH$_2$CH$_2$COOH, —CH$_2$CH(COOH)CH$_3$, —CH$_2$CH$_2$CH$_2$CH$_2$CH$_2$COOH, —CH$_2$CH(COOH)CH$_2$CH$_3$, —CH(COOH)CH$_2$CH$_3$ and —C(CH$_3$)$_2$CH$_2$COOH.

The term "cycloalkyl" as employed herein includes saturated and partially unsaturated cyclic hydrocarbon groups having 3 to 12 carbons, 3 to 8 carbons, or 3 to 6 carbons, wherein the cycloalkyl group additionally is optionally substituted. Some cycloalkyl groups include, without limitation, cyclopropyl, cyclobutyl, cyclopentyl, cyclopentenyl, cyclohexyl, cyclohexenyl, cycloheptyl, and cyclooctyl.

The term "heteroaryl" refers to an aromatic 5-10 membered monocyclic, 8-12 membered bicyclic, or 11-14 membered tricyclic ring system having 1-3 heteroatoms if monocyclic, 1-6 heteroatoms if bicyclic, or 1-9 heteroatoms if tricyclic, said heteroatoms selected from O, N, or S (e.g., carbon atoms and 1-3, 1-6, or 1-9 heteroatoms of O, N, or S if monocyclic, bicyclic, or tricyclic, respectively), wherein 0, 1, 2, 3, or 4 atoms of each ring are substituted by a substituent. Examples of heteroaryl groups include, but are not limited to, pyridyl, furyl or furanyl, imidazolyl, benzimidazolyl, pyrimidinyl, thiophenyl or thienyl, quinolinyl, indolyl, thiazolyl, and the like.

The term "heteroarylalkyl" or the term "heteroaralkyl" refers to an alkyl substituted with a heteroaryl. The term "heteroarylalkoxy" refers to an alkoxy substituted with heteroaryl.

The term "heterocyclyl" refers to a nonaromatic 5-8 membered monocyclic, 8-12 membered bicyclic, or 11-14 membered tricyclic ring system having 1-3 heteroatoms if monocyclic, 1-6 heteroatoms if bicyclic, or 1-9 heteroatoms if tricyclic, said heteroatoms selected from O, N, or S (e.g., carbon atoms and 1-3, 1-6, or 1-9 heteroatoms of O, N, or S if monocyclic, bicyclic, or tricyclic, respectively), wherein 0, 1, 2 or 3 atoms of each ring are substituted by a substituent. Examples of heterocyclyl groups include, but are not limited to, piperazinyl, pyrrolidinyl, dioxanyl, morpholinyl, tetrahydrofuranyl, and the like.

The term "substituent" refers to a group replacing a second atom or group such as a hydrogen atom on any molecule, compound or moiety. Suitable substituents include, without limitation, halo, hydroxy, mercapto, oxo, nitro, haloalkyl, alkyl, alkaryl, aryl, aralkyl, alkoxy, thioalkoxy, aryloxy, amino, alkoxycarbonyl, amido, carboxy, alkanesulfonyl, alkylcarbonyl, and cyano groups.

In some embodiments, the composition comprises an analog comprises one or more asymmetric centers and thus occur as racemates and racemic mixtures, single enantiomers, individual diastereomers and diastereomeric mixtures. Preparation of pure enantiomers or mixtures of desired enantiomeric excess (ee) or enantiomeric purity are accomplished by one or more of the many methods of (a) separation or resolution of enantiomers, or (b) enantioselective synthesis known to those of skill in the art, or a combination thereof. These resolution methods generally rely on chiral recognition and include, for example, chromatography using chiral stationary phases, enantioselective host-guest complexation, resolution or synthesis using chiral auxiliaries, enantioselective synthesis, enzymatic and nonenzymatic kinetic resolution, or spontaneous enantioselective crystallization. Such methods are disclosed generally in Chiral Separation Techniques: A Practical Approach (2nd Ed.), G. Subramanian (ed.), Wiley-VCH, 2000; T. E. Beesley and R. P. W. Scott, Chiral Chromatography, John Wiley & Sons, 1999; and Satinder Ahuja, Chiral Separations by Chromatography, Am. Chem. Soc., 2000. Furthermore, there are equally well-known methods for the quantitation of enantiomeric excess or purity, for example, GC, HPLC, CE, or NMR, and assignment of absolute configuration and conformation, for example, CD ORD, X-ray crystallography, or NMR.

All tautomeric forms and isomeric forms and mixtures, whether individual geometric isomers or stereoisomers or racemic or non-racemic mixtures, of a chemical structure or wntire analog is intended, unless the specific stereochemistry or isomeric form is specifically indicated in the analog name, chemical name or structure. All such isomeric forms of these compositions are included in the present invention unless expressly provided otherwise. In some embodiments, the analogs of this invention are also represented in multiple tautomeric forms, in such instances, the invention includes all tautomeric forms of the analogs described herein (e.g., if alkylation of a ring system results in alkylation at multiple sites, the invention includes all such reaction products). All such isomeric forms of such analogs are included in the present invention unless expressly provided otherwise. All crystal forms of the analogs described herein are included in the present invention unless expressly provided otherwise. All deuterated form of the analogs described herein are included in the present invention. In some embodiments as least one hydrogen atom of the analog is replace with a deuterium atom. In some embodiments at least one hydrogen atom that is involved with a hydrogen-bond is replaced with a deuterium atom. In some embodiments at least one solvent exchangeable hydrogen atom is replaced with a deuterium atom. In some embodiments, the compositions, pharmaceutical compositions, and analogs contained therein comprise from about 1% to about 100% of their hydrogen replaced with deuterium atoms. In some embodiments, the compositions, pharmaceutical compositions, and analogs contained therein comprise from about 90% to about 100% of their hydrogen replaced with deuterium atoms. In some embodiments, the compositions, pharmaceutical compositions, and analogs contained therein comprise from about 80% to about 90% of their hydrogen replaced with deuterium atoms. In some embodiments, the compositions, pharmaceutical compositions, and analogs contained therein comprise from about 70% to about 80% of their hydrogen replaced with deuterium atoms. In some embodiments, the compositions, pharmaceutical compositions, and analogs contained therein comprise from about 60% to about 70% of their hydrogen replaced with deuterium atoms. In some embodiments, the compositions, pharmaceutical compositions, and analogs contained therein comprise from about 50% to about 60% of their hydrogen replaced with deuterium atoms. In some embodiments, the compositions, pharmaceutical compositions, and analogs contained therein comprise from about 40% to about 50% of their hydrogen replaced with deuterium atoms. In some embodiments, the compositions, pharmaceutical compositions, and analogs contained therein comprise from about 30% to about 40% of their hydrogen replaced with deuterium atoms. In some embodiments, the compositions, pharmaceutical compositions, and analogs contained therein comprise from about 20% to about 30% of their hydrogen replaced with deuterium atoms. In some embodiments, the compositions, pharmaceutical compositions, and analogs contained therein comprise from about 10% to about 20% of their hydrogen replaced with deuterium atoms. In some embodiments, the compositions, pharmaceutical compositions, and analogs contained therein comprise from about 5% to about 10% of their hydrogen replaced with deuterium atoms. If the analog of the claimed invention includes a methyl group, a deutrated analog may have one, two, or three of the hydrogens replaced by deuterium atoms. In some embodiments, the analog may contain one or more radioisotopes. In some embodiments, as least one hydrogen atom of the analog is replace with a tritium atom. In some embodiments, the compositions, pharmaceutical compositions, and analogs contained therein comprise from about 1% to about 5% of their hydrogens are replaced with tritium atoms.

As used herein, the terms "increase" and "decrease" mean, respectively, to cause a statistically significantly (i.e., p<0.15) increase or decrease of at least 1%, 2%, or 5%.

As used herein, the recitation of a numerical range for a variable is intended to convey that the invention may be practiced with the variable equal to any of the values within that range. Thus, for a variable which is inherently discrete, the variable is equal to any integer value within the numerical range, including the end-points of the range. Similarly, for a variable which is inherently continuous, the variable is equal to any real value within the numerical range, including the end-points of the range. As an example, and without limitation, a variable which is described as having values between 0 and 2 takes the values 0, 1 or 2 if the variable is inherently discrete, and takes the values 0.0, 0.1, 0.01, 0.001, $10^{-12}$, $10^{-11}$, $10^{-10}$, $10^{-9}$, $10^{-8}$, $10^{-7}$, $10^{-6}$, $10^{-5}$, $10^{-4}$ or any other real values $\geq 0$ and $\leq 2$ if the variable is inherently continuous.

As used herein, unless specifically indicated otherwise, the word "or" is used in the inclusive sense of "and/or" and not the exclusive sense of "either/or."

The term "biological activity" encompasses structural and functional properties of a macrocycle of the invention. Biological activity is, for example, structural stability, alpha-helicity, affinity for a target, resistance to proteolytic degradation, cell penetrability, intracellular stability, in vivo stability, or any combination thereof.

The terms "prodrug" or "prodrug derivative" mean a covalently-bonded derivative or carrier of the analog of the claimed invention or active drug substance which undergoes at least some biotransformation prior to exhibiting its pharmacological effect(s). In general, such prodrugs have metabolically cleavable groups and are rapidly transformed in vivo to yield the analog of the claimed invention, for example, by hydrolysis in blood, and generally include esters and amide analogs of the analogs. The prodrug is formulated with the objectives of improved chemical stability, improved patient acceptance and compliance, improved bioavailability, prolonged duration of action, improved organ selectivity, improved formulation (e.g., increased hydrosolubility), and/or decreased side effects (e.g., toxicity). In general, prodrugs themselves have weak or no biological activity and are stable under ordinary conditions. Prodrugs can be readily prepared from the analogs using methods known in the art, such as those described in A Textbook of Drug Design and Development, Krogsgaard-Larsen and H. Bundgaard (eds.), Gordon & Breach, 1991, particularly Chapter 5: "Design and Applications of Prodrugs"; Design of Prodrugs, H. Bundgaard (ed.), Elsevier, 1985; Prodrugs: Topical and Ocular Drug Delivery, K. B. Sloan (ed.), Marcel Dekker, 1998; Methods in Enzymology, K. Widder et al. (eds.), Vol. 42, Academic Press, 1985, particularly pp. 309-396; Burger's Medicinal Chemistry and Drug Discovery, 5th Ed., M. Wolff (ed.), John Wiley & Sons, 1995, particularly Vol. 1 and pp. 172-178 and pp. 949-982; Pro-Drugs as Novel Delivery Systems, T. Higuchi and V. Stella (eds.), Am. Chem. Soc., 1975; and Bioreversible Carriers in Drug Design, E. B. Roche (ed.), Elsevier, 1987, each of which is incorporated herein by reference in their entireties. In some embodiments, the analog may be a prodrug that, when administered to the subject becomes biologically active.

In some embodiments, the invention relates to a composition or pharmaceutical composition comprising a pharmaceutically acceptable prodrug that, when administered to the subject becomes biologically active. The term "pharmaceutically acceptable prodrug" as used herein means a prodrug of a compound of the invention which is, within the scope of sound medical judgment, suitable for use in contact with the tissues of humans and lower animals without undue toxicity, irritation, allergic response, and the like, commensurate with a reasonable benefit/risk ratio, and effective for their intended use, as well as the zwitterionic forms, where possible.

In some embodiments, the analog of the claimed invention is a pharmaceutically-acceptable acid addition salt. The term "pharmaceutically-acceptable acid addition salt" means those salts which retain the biological effectiveness and properties of the free bases and which are not biologically or otherwise undesirable, formed with inorganic acids such as hydrochloric acid, hydrobromic acid, hydroiodic acid, sulfuric acid, sulfamic acid, nitric acid, phosphoric acid, and the like, and organic acids such as acetic acid, trichloroacetic acid, trifluoroacetic acid, adipic acid, alginic acid, ascorbic acid, aspartic acid, benzenesulfonic acid, benzoic acid, 2-acetoxybenzoic acid, butyric acid, camphoric acid, camphorsulfonic acid, cinnamic acid, citric acid, digluconic acid, ethanesulfonic acid, glutamic acid, glycolic acid, glycerophosphoric acid, hemisulfic acid, heptanoic acid, hexanoic acid, formic acid, fumaric acid, 2-hydroxyethanesulfonic acid (isethionic acid), lactic acid, maleic acid, hydroxymaleic acid, malic acid, malonic acid, mandelic acid, mesitylenesulfonic acid, methanesulfonic acid, naphthalenesulfonic acid, nicotinic acid, 2-naphthalenesulfonic acid, oxalic acid, pamoic acid, pectinic acid, phenylacetic acid, 3-phenylpropionic acid, picric acid, pivalic acid, propionic acid, pyruvic acid, pyruvic acid, salicylic acid, stearic acid, succinic acid, sulfanilic acid, tartaric acid, p-toluenesulfonic acid, undecanoic acid, and the like. In some embodiments, the analog of the claimed invention is a pharmaceutically-acceptable base addition salt. The term "pharmaceutically-acceptable base addition salt" means those salts which retain the biological effectiveness and properties of the free acids and which are not biologically or otherwise undesirable, formed with inorganic bases such as ammonia or hydroxide, carbonate, or bicarbonate of ammonium or a metal cation such as sodium, potassium, lithium, calcium, magnesium, iron, zinc, copper, manganese, aluminum, and the like. Suitable salts include the ammonium, potassium, sodium, calcium, and magnesium salts. Salts derived from pharmaceutically-acceptable organic nontoxic bases include salts of primary, secondary, and tertiary amines, quaternary amine compounds, substituted amines including naturally occurring substituted amines, cyclic amines and basic ion-exchange resins, such as methylamine, dimethylamine, trimethylamine, ethylamine, diethylamine, triethylamine, isopropylamine, tripropylamine, tributylamine, ethanolamine, diethanolamine, 2-dimethylaminoethanol, 2-diethylaminoethanol, dicyclohexylamine, lysine, arginine, histidine, caffeine, hydrabamine, choline, betaine, ethylenediamine, glucosamine, methylglucamine, theobromine, purines, piperazine, piperidine, N-ethylpiperidine, tetramethylammonium compounds, tetraethylammonium compounds, pyridine, N,N-dimethylaniline, N-methylpiperidine, N-methylmorpholine, dicyclohexylamine, dibenzylamine, N,N-dibenzylphenethylamine, 1-ephenamine, N,N'-dibenzylethylenediamine, polyamine resins, and the like. In some embodiments, the composition of the claimed invention comprises at least one organic nontoxic bases chosen from isopropylamine, diethylamine, ethanolamine, trimethylamine, dicyclohexylamine, choline, and caffeine.

The term "solvate" means a physical association of a compound with one or more solvent molecules or a complex of variable stoichiometry formed by a solute (the analog of the claimed invention) and a solvent, for example, water, ethanol, or acetic acid. This physical association may involve varying degrees of ionic and covalent bonding, including hydrogen bonding. In certain instances, the solvate will be capable of isolation, for example, when one or more solvent molecules are incorporated in the crystal lattice of the crystalline solid. In general, the solvents selected do not interfere with the biological activity of the solute. Solvates encompasses both solution-phase and isolatable solvates. Representative solvates include hydrates, ethanolates, and methanolates.

The invention relates to compositions comprising an analog of a naturally occurring polypeptide sequence. In some embodiments the invention relates to a composition comprising an analog of a naturally occurring polypeptide sequence wherein the analog is from about 80% to 99% homologous to a naturally occurring polypeptide sequence. In some embodiments the invention relates to a composition comprising an analog of a naturally occurring polypeptide sequence wherein the analog is from about 80% to 85% homologous to a naturally occurring polypeptide sequence.

In some embodiments the invention relates to a composition comprising an analog of a naturally occurring polypeptide sequence wherein the analog is from about 85% to 90% homologous to a naturally occurring polypeptide sequence. In some embodiments the invention relates to a composition comprising an analog of a naturally occurring polypeptide sequence wherein the analog is from about 90% to 95% homologous to a naturally occurring polypeptide sequence. In some embodiments the invention relates to a composition comprising an analog of a naturally occurring polypeptide sequence wherein the analog is from about 95% to 99% homologous to a naturally occurring polypeptide sequence. In some embodiments the invention relates to a composition comprising an analog of a naturally occurring polypeptide sequence wherein the analog is about 95%, 96%, 97%, 98%, or 99% homologous to a naturally occurring polypeptide sequence. In some embodiments the analog is derived from the naturally occurring polypeptide of the secretin family. In some embodiments, the analog is derived from the naturally occurring polypeptide of the secretin family and has at least one β-amino acid residue and/or at least one modified amino acid residue comprising APC or ACPC. Table 1 below illustrates the known wild-type sequences of each naturally occurring human secretin family members:

TABLE 1

| Amino Acid Sequences for Peptides of the Secretin Family |
| --- |
| GHRF      YADAIFTNSYRKVLGQLSARKLLQDIMSRQQGESNQERG (SEQ ID NO: 1)<br>ARARL |
| GIP       YAEGTFISDYSIAMDKIHQQDFVNWLLAQKGKKNDWKHNITQ (SEQ ID NO: 2) |
| GLP-1     HDEFERHAEGTFTSDVSSYLEGQAAQGFIAWLVKGRG (SEQ ID NO: 3) |
| Glucagon  HSQGTFTSDYSKYLDSRRAQDFVQWLMNT (SEQ ID NO: 4) |
| PACAP-27  HSDGIFTDSYSRYRKQMAVKKYLAAVL (SEQ ID NO: 5) |
| PACAP-38  HSDGIFTDSYSRYRKQMAVKKYLAAVLGKRYKQRVKNK (SEQ ID NO: 6) |
| PHM       HADGVFTSDFSKLLGQLSAKKYLESLM (SEQ ID NO: 7) |
| PrP       DVAHGILNEAYRKVLGQLSAGKHLQSLVA (SEQ ID NO: 8) |
| Secretin  HSDGTFTSELSRLREGARLQRLLQGLV (SEQ ID NO: 9) |
| VIP       HSDAVFTDNYTRLRKQMAVKKYLNSILN (SEQ ID NO: 10) |

TABLE 2

| Amino Acid Sequences for Interleukins |
| --- |
| IL-10<br>>gi\|10835141\|ref\|NP_000563.1\|interleukin-10 precursor {Homo sapiens}<br>(SEQ ID NO: 11)<br>MHSSALLCCLVLLTGVRASPGQGTQSENSCTHFPGNLPNMLRDLRDAFSRVKTFFQMKDQL<br>DNLLLKESLLEDFKGYLGCQALSEMIQFYLEEVMPQAENQDPDIKAHVNSLGENLKTLRLRL<br>RRCHRFLPCENKSKAVEQVKNAFNKLQEKGIYKAMSEFDIFINYIEAYMTMKIRN |

TABLE 2-continued

Amino Acid Sequences for Interleukins

IL-4
>gi|4504669|ref|NP_000580.1|interleukin-4 isoform 1 precursor {Homo sapiens}
(SEQ ID NO: 12)
MGLTSQLLPPLFFLLACAGNFVHGHKCDITLQEIIKTLNSLTEQKTLCTELTVTDIFAASKNTT
EKETFCRAATVLRQFYSHHEKDTRCLGATAQQFHRHKQLIRFLKRLDRNLWGLAGLNSCPV
KEANQSTLENFLERLKTIMREKYSKCSS >gi|27477092|ref|NP_758858.1|interleukin-4 isoform 2 precursor {Homo sapiens}
(SEQ ID NO: 13)
MGLTSQLLPPLFFLLACAGNFVHGHKCDITLQEIIKTLNSLTEQKNTTEKETFCRAATVLRQF
YSHHEKDTRCLGATAQQFHRHKQLIRFLKRLDRNLWGLAGLNSCPVKEANQSTLENFLERL
KMREKYSKCSS IL-5
>gi|4504671|ref|NP_000870.1|interleukin 5 precursor {Homo sapiens}
(SEQ ID NO: 14)
MRMLLHLSLLALGAAYVYAIPTEIPTSALVKETLALLSTHRTLLIANETLRIPVPVHKNHQLCT
EEIFQGIGTLESQTVQGGTVERLFKNLSLIKKYIDGQKKKCGEERRRVNQFLDYLQEFLGVMN
TEWIIES IL-8
>gi|10834978|ref|NP_000575.1|interleukin-8 precursor {Homo sapiens}
(SEQ ID NO: 15)
MTSKLAVALLAAFLISAALCEGAVLPRSAKELRCQCIKTYSKPFHPKFIKELRVIESGPHCANT
EIIVKLSDGRELCLDPKENWVQRVVEKFLKRAENS IL-12A
>gi|24430219|ref|NP_000873.2|interleukin-12 subunit alpha precursor {Homo sapiens}
(SEQ ID NO: 16)
MWPPGSASQPPPSPAAATGLHPAARPVSLQCRLSMCPARSLLLLVATLVLLDHLSLARNLPVA
TPDPGMFPCLHHSQNLLRAVSNMLQKARQTLEFYPCTSEEIDHEDITKDKTSTVEACLPLELT
KNESCLNSRETSFITNGSCLASRKTSFMMALCLSSIYEDLKMYQVEFKTMNAKLLMDPKRQI
FLDQNMLAVIDELMQALNFNSETVPQKSSLEEPDFYKTKIKLCILLHAFRIRAVTIDRVMSYL
NAS IL-12B
>gi|24497438|ref|NP_002178.2|interleukin-12 subunit beta precursor {Homo sapiens}
(SEQ ID NO: 17)
MCHQQLVISWFSLVFLASPLVAIWELKKDVYVVELDWYPDAPGEMVVLTCDTPEEDGITWT
LDQSSEVLGSGKTLTIQVKEFGDAGQYTCHKGGEVLSHSLLLLHKKEDGIWSTDILKDQKEP
KNKTFLRCEAKNYSGRFTCWWLTTISTDLTFSVKSSRGSSDPQGVTCGAATLSAERVRGDNK
EYEYSVECQEDSACPAAEESLPIEVMVDAVHKLKYENYTSSFFIRDIIKPDPPKNLQKPLKNS
RQVEVSWEYPDTWSTPHSYFSLTFCVQVQGKSKREKKDRVFTDKTSATVICRKNASISVRAQ
DRYYSSSWSEWASVPCS IL-2
>gi|28178861|ref|NP_000577.2|interleukin 2 precursor {Homo sapiens}
(SEQ ID NO: 18)
MYRMQLLSCIALSLALVTNSAPTSSSTKKTQLQLEHLLLDLQMILNGINNYKNPKLTRMLTF
KFYMPKKATELKHLQCLEEELKPLEEVLNLAQSKNFHLRPRDLISNINVIVLELKGSETTFMC
EYADETATIVEFLNRWITFCQSIISTLT IL-15
gi|26787984|ref|NP_751914.1|interleukin 15 preproprotein {Homo sapiens}
(SEQ ID NO: 19)
MRISKPHLRSISIQCYLCLLLNSHFLTEAGIHVFILGCFSAGLPKTEANWVNVISDLKKIEDLIQ
SMHIDATLYTESDVHPSCKVTAMKCFLLELQVISLESGDASIHDTVENLIILANNSLSSNGNVT
ESGCKECEELEEKNIKEFLQSFVHIVQMFINTS gi|10835153|ref|NP_000576.1|interleukin 15 preproprotein {Homo sapiens}
(SEQ ID NO: 20)
MRISKPHLRSISIQCYLCLLLNSHFLTEAGIHVFILGCFSAGLPKTEANWVNVISDLKKIEDLIQ
SMHIDATLYTESDVHPSCKVTAMKCFLLELQVISLESGDASIHDTVENLIILANNSLSSNGNVT
ESGCKECEELEEKNIKEFLQSFVHIVQMFINTS IL-17
>gi|4504651|ref|NP_002181.1|interleukin 17A precursor {Homo sapiens}
(SEQ ID NO: 21)
MTPGKTSLVSLLLLLSLEAIVKAGITIPRNPGCPNSEDKNFPRTVMVNLNIHNRNTNTNPKRSS
DYYNRSTSPWNLHRNEDPERYPSVIWEAKCRHLGCINADGNVDYHMNSVPIQQEILVLRREP
PHCPNSFRLEKILVSVGCTCVTPIVHHVA IL-18
>gi|4504653|ref|NP_001553.1|interleukin-18 proprotein {Homo sapiens}
(SEQ ID NO: 22)
MAAEPVEDNCINFVAMKFIDNTLYFIAEDDENLESDYFGKLESKLSVIRNLNDQVLFIDQGNR
PLFEDMTDSDCRDNAPRTIFIISMYKDSQPRGMAVTISVKCEKISTLSCENKIISFKEMNPPDNI

TABLE 2-continued

Amino Acid Sequences for Interleukins

KDTKSDIIFFQRSVPGHDNKMQFESSSYEGYFLACEKERDLFKLILKKEDELGDRSIMFTVQN
ED

Interleukin-18-binding protein isoform a precursor {Homo sapiens}
>gi|89111125|ref|NP_001034748.1|interleukin-18-binding protein isoform a precursor {Homo sapiens}
(SEQ ID NO: 23)

MTMRHNWTPDLSPLWVLLLCAHVVTLLVRATPVSQTTTAATASVRSTKDPCPSQPPVFPAA
KQCPALEVTWPEVEVPLNGTLSLSCVACSRFPNFSILYWLGNGSFIEHLPGRLWEGSTSRERG
STGTQLCKALVLEQLTPALHSTNFSCVLVDPEQVVQRHVVLAQLWAGLRATLPPTQEALPSS
HSSPQQQ

IL-21
>gi|11141875|ref|NP_068575.1|interleukin-21 {Homo sapiens}
(SEQ ID NO: 24)

MRSSPGNMERIVICLMVIFLGTLVHKSSSQGQDRHMIRMRQLIDIVDQLKNYVNDLVPEFLPA
PEDVETNCEWSAFSCFQKAQLKSANTGNNERIINVSIKKLKRKPPSTNAGRRQKHRLTCPSCD
SYEKKPPKEFLERFKSLLQKMIHQHLSSRTHGSEDS

IL-22
>gi|10092625|ref|NP_065386.1|interleukin-22 precursor {Homo sapiens}
(SEQ ID NO: 25)

MAALQKSVSSFLMGTLATSCLLLLALLVQGGAAAPISSHCRLDKSNFQQPYITNRTFMLAKE
ASLADNNTDVRLIGEKLFHGVSMSERCYLMKQVLNFTLEEVLFPQSDRFQPYMQEVVPFLAR
LSNRLSTCHIEGDDLHIQRNVQKLKDTVKKLGESGEIKAIGELDLLFMSLRNACI

IL-24
>gi|5803086|ref|NP_006841.1|interleukin 24 isoform 1 precursor {Homo sapiens}
(SEQ ID NO: 26)

MNFQQRLQSLWTLARPFCPPLLATASQMQMVVLPCLGFTLLLWSQVSGAQGQEFHFGPCQV
KGVVPQKLWEAFWAVKDTMQAQDNITSARLLQQEVLQNVSDAESCYLVHTLLEFYLKTVF
KNYHNRTVEVRTLKSFSTLANNFVLIVSQLQPSQENEMFSIRDSAHRRFLLFRRAFKQLDVEA
ALTKALGEVDILLTWMQKFYKL

>gi|31317246|ref|NP_851936.1|interleukin-24 isoform 2 {Homo sapiens}
(SEQ ID NO: 27)

MFSIRDSAHRRFLLFRRAFKQLDVEAALTKALGEVDILLTWMQKFYKL

IL-26
>gi|8923756|ref|NP_060872.1|interleukin-26 precursor {Homo sapiens}
(SEQ ID NO: 28)

MLVNFILRCGLLLVTLSLAIAKHKQSSFTKSCYPRGTLSQAVDALYIKAAWLKATIPEDRIKNI
RLLKKKTKKQFMKNCQFQEQLLSFFMEDVFGQLQLQGCKKIRFVEDFHSLRQKLSHCISCAS
SAREMKSITRMKRIFYRIGNKGIYKAISELDILLSWIKKLLESSQ

TABLE 3

Amino Acid Sequences for Anti-inflammatory Neuropeptides pro-opiomelanocortin preproprotein {Homo sapiens}
>gi|4505949|ref|NP_000930.1|pro-opiomelanocortin preproprotein {Homo sapiens}
(SEQ ID NO: 29)

MPRSCCSRSGALLLALLLQASMEVRGWCLESSQCQDLTTESNLLECIRACKPDLSAE
TPMFPGNGDEQPLTENPRKYVMGHFRWDRFGRRNSSSGSSGAGQKREDVSAGEDC
GPLPEGGPEPRSDGAKPGPREGKRSYSMEHFRWGKPVGKKRRPVKVYPNGAEDESA
EAFPLEFKRELTGQRLREGDGPDGPADDGAGAQADLEHSLLVAAEKKDEGPYRMEH
FRWGSPPKDKRYGGFMTSEKSQTPLVTLFKNAIIKNAYKKGE

Activeform:
α-MSH SYSMEHFRWGKPV-NH2 (SEQ ID NO: 581)

>gi|490074|emb|CAA00890.1|ACTH {Homo sapiens}
GPSYSMEHFRWGKPVGKKRRPVKVYPNGAEDESAEAFPLEF urocortin preproprotein {Homo sapiens}
>gi|4507803|ref|NP_003344.1|urocortin preproprotein {Homo sapiens}
(SEQ ID NO: 30)

MRQAGRAALLAALLLLVQLCPGSSQRSPEAAGVQDPSLRWSPGARNQGGGARALL
LLLAERFPRRAGPGRLGLGTAGERPRRDNPSLSIDLTFHLLRTLLELARTQSQRERAE
QNRIIFDSVGK

TABLE 3-continued

Amino Acid Sequences for Anti-inflammatory Neuropeptides

Activeform:
Urocortin DNPSLSIDLTFHLLRTLLELADTQSQRERAQNRIIFDSV-
NH2 (SEQ ID NO: 1336)

urocortin-2 preproprotein {Homo sapiens}
>gi|15082240|ref|NP_149976.1|urocortin-2 preproprotein {Homo sapiens}
(SEQ ID NO: 31)

MTRCALLLLMVLMLGRVLVVPVTPIPTFQLRPQNSPQTTPRPAASESPSAAPTWPWA
AQSHCSPTRHPGSRIVLSLDVPIGLLQILLEQARARAAREQATTNARILARVGHC urocortin-3 preproprotein {Homo sapiens}
>gi|145238845|ref|NP_444277.2|urocortin-3 preproprotein {Homo sapiens}
(SEQ ID NO: 32)

MLMPVHFLLLLLLLGGPRTGLPHKFYKAKPIFSCLNTALSEAEKGQWEDASLLSKR
SFPHYLRSRDASSGEEEEGKEKKTFPISGARGGARGTRYRYVSQAQPRGKPRQDTAKS
PHRTKFTLSLDVPTNIMNLLFNIAKAKNLRAQAAANAHLMAQIGRKK adrenomedullin precursor {Homo sapiens}
>gi|4501945|ref|NP_001115.1|adrenomedullin precursor {Homo sapiens}
(SEQ ID NO: 33)

MKLVSVALMYLGSLAFLGADTARLDVASEFRKKWNKWALSRGKRELRMSSSYPTG
LADVKAGPAQTLIRPQDMKGASRSPEDSSPDAARIRVKRYRQSMNNFQGLRSFGCRF
GTCTVQKLAHQIYQFTDKDKDNVAPRSKISPQGYGRRRRRSLPEAGPGRTLVSSKPQ
AHGAPAPPSGSAPHFL gi|41152110|ref|NP_079142.2|adrenomedullin 2 precursor {Homo sapiens}
(SEQ ID NO: 1337)

MARIPTAALGCISLLCLQLPGSLSRSLGGDPRPVKPREPPARSPSSSLQPRHPAPRPVV
WKLHRALQAQRGAGLAPVMGQPLRDGGRQHSGPRRHSGPRRTQAQLLRVGCVLGT
CQVQNLSHRLWQLMGPAGRQDSAPVDSSPHSYG

Active portion:
Adrenomedullin
YRQSMNNFQGLRFG{CRFGTC}TVQKLAHQIYQFTDKDKDNVAPRNKISPQ
GY-NH2 (SEQ ID NO: 1338)

cortistatin preproprotein {Homo sapiens}
>gi|41327683|ref|NP_001293.2|cortistatin preproprotein {Homo sapiens}
(SEQ ID NO: 34)

MYRHKNSWRLGLKYPPSSKEETQVPKTLISGLPGRKSSSRVGEKLQSAHKMPLSPGL
LLLLLSGATATAALPLEGGPTGRDSEHMQEAAGIRKSSLLTFLAWWFEWTSQASAGP
LIGEEAREVARRQEGAPPQQSARRDRMPCRNFEWKTFSSCK
Active form:

Cortistatin DRMP{CKNFFWKTFSSC}K-NH2 (SEQ ID NO: 1339)

somatostatin preproprotein {Homo sapiens}
>gi|4507243|ref|NP_001039.1|somatostatin preproprotein {Homo sapiens}
(SEQ ID NO: 35)

MLSCRLQCALAALSIVLALGCVTGAPSDPRLRQFLQKSLAAAAGKQELAKYFLAELL
SEPNQTENDALEPEDLSQAAEQDEMRLELQRSANSNPAMAPRERKAGCKNFFWKTF
TSC appetite-regulating hormone isoform 1 preproprotein {Homo sapiens}
>gi|7706519|ref|NP_057446.1|appetite-regulating hormone isoform 1 preproprotein {Homo sapiens}
(SEQ ID NO: 36)

MPSPGTVCSLLLLGMLWLDLAMAGSSFLSPEHQRVQQRKESKKPPAKLQPRALAGW
LRPEDGGQAEGAEDELEVRFNAPFDVGIKLSGVQYQQHSQALGKFLQDILWEEAKE
APADK appetite-regulating hormone isoform 2 preproprotein {Homo sapiens}
>gi|201860279|ref|NP_001128413.1|appetite-regulating hormone isoform 2 preproprotein {Homo sapiens}
(SEQ ID NO: 37)

MPSPGTVCSLLLLGMLWLDLAMAGSSFLSPEHQRVQRKESKKPPAKLQPRALAGWL
RPEDGGQAEGAEDELEVRFNAPFDVGIKLSGVQYQQHSQALGKFLQDILWEEAKEA
PADK appetite-regulating hormone isoform 3 preproprotein {Homo sapiens}
>gi|201860281|ref|NP_001128416.1|appetite-regulating hormone isoform 3 preproprotein {Homo sapiens}
(SEQ ID NO: 38)

MFTCWWSYLRSTLAAVPGEASRVQQRKESKKPPAKLQPRALAGWLRPEDGGQAEG
AEDELEVRFNAPFDVGIKLSGVQYQQHSQALGKFLQDILWEEAKEAPADK

TABLE 3-continued

Amino Acid Sequences for Anti-inflammatory Neuropeptides appetite-regulating hormone isoform 4 preproprotein {Homo sapiens}
>gi|201860283|ref|NP_001128417.1|appetite-regulating hormone isoform 4 preproprotein
{Homo sapiens}
(SEQ ID NO: 39)
MFTCWWSYLRSTLAAVPGEASRVQRKESKKPPAKLQPRALAGWLRPEDGGQAEGA
EDELEVRFNAPFDVGIKLSGVQYQQHSQALGKFLQDILWEEAKEAPADK appetite-regulating hormone isoform 5 preproprotein {Homo sapiens}
>gi|201860285|ref|NP_001128418.1|appetite-regulating hormone isoform 5 preproprotein
{Homo sapiens}
(SEQ ID NO: 40)
MFTCWWSYLRSTLAAVPGEASRVQFNAPFDVGIKLSGVQYQQHSQALGKFLQDILW
EEAKEAPADK ghrelin {Homo sapiens}
>gi|53794041|gb|AAU93610.1|ghrelin {Homo sapiens}
(SEQ ID NO: 41)
MPSPGTVCSLLLLGMLWLDLAMAGSSFLSPEHQRVQ Active form: Ghrelin GSSFLSPEHQRVQQRKESKKPPAKLPQR-NH2 (SEQ ID NO: 567)
(Expert Opin. Biol. Ther. (2007) 7(4): 461-478)

In some embodiments, the composition comprises a VIP analog. In some embodiments, the composition comprises a Secretin analog. In some embodiments, the composition comprises a PrP analog. In some embodiments, the composition comprises a PrP analog. In some embodiments, the composition comprises a PHM analog. In some embodiments, the composition comprises a PACAP-27 analog. In some embodiments, the composition comprises a PACAP-38 analog. In some embodiments, the composition comprises a Glucagon analog. In some embodiments, the composition comprises a GLP-1 analog. In some embodiments, the composition comprises a GIP analog. In some embodiments, the composition comprises a GHRF analog. In some embodiments, the composition comprises a secretin family analog that is derived from mammalian amino acid sequences of secretin family polypeptides other than humans. In some embodiments, the secretin family analog may be selective for one particular receptor versus another. In some embodiments, the composition comprises a secretin analog wherein the secretin analog is selective for, or preferentially binds to, VPAC1, VPAC2, PAC1, VIPR1, or VIPR2. In some embodiments, the composition comprises a secretin analog wherein the secretin analog is selective for, or preferentially binds, VPAC1. In some embodiments, the composition comprises a secretin analog wherein the secretin analog is selective for, or preferentially binds, VPAC2. In some embodiments, the composition comprises a secretin analog wherein the secretin analog is selective for, or preferentially binds, PAC1. In some embodiments, the composition comprises a secretin analog wherein the secretin analog is selective for, or preferentially binds, VIPR1. In some embodiments, the composition comprises a secretin analog wherein the secretin analog is selective for, or preferentially binds, VIPR2. In some embodiments, the secretin analog is an agonist of at least one of the following: VPAC1, VPAC2, PAC1, VIPR1, or VIPR2. In some embodiments, the secretin analog is an antagonist of at least one of the following: VPAC1, VPAC2, PAC1, VIPR1, or VIPR2.

In some embodiments, the composition comprises a apolipoprotein A-1 analog. In some embodiments the apoA-1 analog is from about 80% to about 99% homologous to the human sequence of apolipoprotein A-1. In some embodiments the apoA-1 analog is from about 80% to about 85% homologous to the human sequence of apolipoprotein A-1. In some embodiments the apoA-1 analog is from about 85% to about 90% homologous to the human sequence of apolipoprotein A-1. In some embodiments the apoA-1 analog is from about 90% to about 95% homologous to the human sequence of apolipoprotein A-1. In some embodiments the apoA-1 analog is from about 95% to about 99% homologous to the human sequence of apolipoprotein A-1. In some embodiments the apoA-1 analog is about 95%, 96%, 97%, 98%, or 99% homologous to the human sequence of apolipoprotein A-1. In some embodiments the apoA-1 analog is from about 80% to about 85% homologous to the following of apolipoprotein A-1 analog: DWFKAFYDKVAEKFKEAF (SEQ ID NO:533).

In some embodiments, the composition comprises a cytokine or interleukin analog. In some embodiments the cytokine or interleukin analog is from about 80% to about 99% homologous to the human sequence of cytokine or interleukin. In some embodiments the cytokine or interleukin analog is from about 80% to about 85% homologous to the human sequence of a cytokine or interleukin. In some embodiments the cytokine or interleukin analog is from about 85% to about 90% homologous to the human sequence of a cytokine or interleukin. In some embodiments the cytokine or interleukin analog is from about 90% to about 95% homologous to the human sequence of a cytokine or interleukin. In some embodiments the cytokine or interleukin analog is from about 95% to about 99% homologous to the human sequence of a cytokine or interleukin. In some embodiments the cytokine or interleukin analog is about 95%, 96%, 97%, 98%, or 99% homologous to the human sequence of a cytokine or interleukin. In some embodiments the cytokine or interleukin analog is from about 80% to about 99% homologous to a cytokine or interleukin chosen from IL-2, IL-4, IL-5, IL-6, IL-7, IL-10, IL-12, IL-15, IL-17, IL-18, IL-21, IL-22, IL-23, IL-24, IL-26, IFN-γ, TNF-α, and TNF-β. In some embodiments, the cytokine or interleukin analog comprises at least one non-natural amino acid within the structure that corresponds to helix F in the naturally occurring polypeptide sequence upon which the analog is based or derived. In some embodiments, the cytokine or interleukin analog comprises at least one non-natural amino acid within the structure that corresponds to AB loop in the naturally occurring polypeptide sequence upon which the analog is based or derived.

The invention relates to the manufacturing of a synthetic polypeptide which is an amino acid sequence that corresponds to the sequence of a biologically active polypeptide or fragment thereof. In the synthetic polypeptide, from about 14% to about 50% of the α-amino acid residues found in the biologically active polypeptide or fragment are replaced with β-amino acid residues. In another embodiment of the invention, the α-amino acid residues and the β-amino acid residues are distributed in a repeating pattern. Human cells are then contacted with the synthetic polypeptide to induce the biochemical pathway or biological activity ordinarily induced by the naturally occurring polypeptide upon which the analog is based.

The compositions of the invention may be prepared by the synthetic chemical procedures described herein, as well as other procedures similar to those which may be used for making β-amino acid peptides. Such procedures include both solution and solid phase procedures, e.g., using either Boc and Fmoc methodologies. The compounds of the invention may be synthesized using solid phase synthesis techniques. Fmoc-N-Protected β-amino acids can be used to synthesize poly-α/β-peptides by conventional manual solid-phase synthesis procedures under standard conditions on any number of solid supports, including ortho-chloro-trityl chloride resin. Esterification of Fmoc-β-amino acids with the ortho-chloro-trityl resin can be performed according to the method of Barlos et. al., Tetrahedron Lett., 1989, 30, 3943. The resin (150 mg, 1.05 mmol CO is swelled in 2 ml $CH_2Cl_2$ for 10 min. A solution of the Fmoc-protected β-amino acid in $CH_2Cl_2$ and $iPr_2EtN$ are then added successively and the suspension is mixed under argon for 4 h. Subsequently, the resin is filtered and washed with $CH_2Cl_2$/MeOH/$iPr_2EtN$ (17:2:1, 3×3 min), $CH_2Cl_2$ (3×3 min), DMF (2×3 min), $CH_2Cl_2$ (3×3 min), and MeOH (2×3 min). The substitution of the resin is determined on a 3 mg sample by measuring the absorbance of the dibenzofulvene adduct at 300 nm. The Fmoc group is removed using 20% piperidine in DMF (4 ml, 2×20 min) under Ar bubbling. The resin is then filtered and washed with DMF (6×3 min). For each coupling step, a solution of the β-amino acid (3 equiv.), BOP (3 equiv.) and HOBT (3 equiv.) in DMF (2 ml) and $iPr_2EtN$ (9 eq) are added successively to the resin and the suspension is mixed for 1 h under Ar. Monitoring of the coupling reaction is performed with 2,4,6-trinitrobenzene-sulfonic acid (TNBS) (W. S. Hancock and J. E. Battersby, Anal. Biochem. (1976), 71, 260). In the case of a positive TNBS test (indicating incomplete coupling), the suspension is allowed to react for a further 1 h. The resin is then filtered and washed with DMF (3×3 min) prior to the following Fmoc deprotection step. After the removal of the last Fmoc protecting group, the resin is washed with DMF (6×3 min), $CH_2Cl_2$ (3×3 min), $Et_2O$ (3×3 min) and dried under vacuum for 3 h. Finally the peptides are cleaved from the resin using 2% TFA in $CH_2Cl_2$ (2 ml, 5×15 min) under Ar. The solvent is removed and the oily residues are triturated in ether to give the crude α-/β-polypeptides. The compounds are further purified by HPLC.

The compositions of the invention may be prepared by the synthetic chemical procedures described herein, as well as other procedures similar to those which may be used for making β-amino acid peptides. Such procedures include both solution and solid phase procedures, e.g., using either Boc or Fmoc methodologies. The compounds of the invention may be synthesized using solid phase synthesis techniques. Fmoc-N-Protected β-amino acids can be used to synthesize poly-α/β-peptides by conventional manual solid-phase synthesis procedures under standard conditions on any number of solid supports, including ortho-chloro-trityl chloride resin, Wang resin (NovaBiochem 0.75 mmol substitution) and Rink amid resin (NovaBiochem 0.55 mmol substitution). Resin is typically swelled in 100% DMF for 30 minutes then deprotected using 20% piperidine in DMF for 2 minutes at 80° (3×). Fmoc protected amino acids (natural or non-natural) can then be coupled to the resin using a cocktail of AA:HATU:DIEA:Resin (3:2.5:4:1, LiCL 0.8M final concentration) in DMF for 2 minutes at 70° (3×). The resin is then washed (3×) with DMF, DCM (dichloromethane) (3×) and again with DMF (3×) between deprotection and coupling steps. Monitoring of the coupling reaction is performed with 2,4,6-trinitrobenzene-sulfonic acid (TNBS) (W. S. Hancock and J. E. Battersby, Anal. Biochem. (1976), 71, 260). In the case of a positive TNBS test (indicating incomplete coupling), the suspension is allowed to react for another three times. This process is repeated until the desired product has been achieved. After the removal of the last Fmoc protecting group, the resin is washed with DMF (3×), $CH_2Cl_2$ (3×) and DMF again (3×). The remaining free-amine group is then acetylated using a cocktail of DIEA: $Ac_2O$ (1:1) for 5 minutes at room temperature. Full-length peptides were then cleaved from solid support using TFA: TIS:$H_2O$ (95:2.5:2.5) for 150 minutes, precipitated in cold ethyl ether and lyophilized. The polymer was reconstituted in a 1:1 solution of A:B (A: $H_2O$, 0.1% TFA) (B: 90:10:0.1 acetonitrile/$H_2O$/TFA).

The compositions described herein may be prepared by successive amide bond-forming procedures in which amide bonds are formed between the β-amino group of a first β-amino acid residue or a precursor thereof and the α-carboxyl group of a second β-amino acid residue or α-amino acid residue or a precursor thereof. The amide bond-forming step may be repeated as many times, and with specific α-amino acid residues and/or β-amino acid residues and/or precursors thereof, as required to give the desired α/β-polypeptide. Also analogs comprising two, three, or more amino acid residues (α- or β-) may be joined together to yield larger analogs comprising any combination of α-, or β-amino acids. Cyclic compounds may be prepared by forming peptide bonds between the N-terminal and C-terminal ends of a previously synthesized linear polypeptide or through the disulfide crosslinking of sidechains of non-adjacent residues. $β^3$-amino acids may be produced enantioselectively from corresponding β-amino acids. For instance, by Arndt-Eisert homologation of N-protected α-amino acids. Homologation may be followed by coupling of the reactive diazoketone intermediate of the Wolff rearrangement with a β-amino acid residue.

In some embodiments, the analog of the invention comprises a repeating pattern of the β-amino acid residues in alignment on a longitudinal axis of the analog in order to constrain the conformation of the analog in an active state or to avoid disruption of the active site. That is, in the folded structure adopted by the analogs of the present invention, the repeating pattern of α- or β-amino acids residues disposes the synthetic non-natural amino acid residues in alignment along one longitudinal axis of the folded molecular structure from N-terminus to C-terminus when the unnatural polypeptides adopt a helical conformation. In some embodiments, the analog of the invention comprises the following alignment of β-amino acids or ACPC or APC along a longitudinal axis of the folded molecular structure from N-terminus to C-terminus when the polypeptide adopts a helical conformation chosen from the following:

wherein the residue positions in a solid dot represent non-natural amino acid residues.

In some embodiments, the analog of the invention comprises the following alignment along a longitudinal axis of the folded molecular structure from N-terminus to C-terminus when the polypeptide adopts a helical conformation chosen from the following:

wherein the positions with solid dots represent β³-amino acid residues.

In some embodiments, the analog of the invention comprises the following alignment along a longitudinal axis of the folded molecular structure from N-terminus to C-terminus when the polypeptide adopts a helical conformation chosen from the following:

wherein the positions with solid dots represent β-amino acid residues.

The repeating pattern of β-amino acid residues and α-amino acid residues may be a pattern of from about two to about seven residues in length, such as (βαααααα), (βαααβαα), (ααααααβ), (αααβ), (ααβ), (ααβ), (ααβαααβ), (ααβαβαβ), and (αβ). All unique patterns of α- or β-amino acids residues from about two to about fourteen residues in length are explicitly within the scope of the invention. All unique patterns of α- or β-amino acids residues from about two to about seven residues in length are explicitly within the scope of the invention. In some embodiments, the composition comprises an analog, wherein the analog wherein the analog comprises a repetitive pattern of sequential β-amino acids from the amino-terminus to the carboxy-terminus, and wherein the analog is an agonist or antagonist of the receptor to which it selectively binds or associates. For instance, in some embodiments, the analog is a VIP analog or a functional fragment thereof that selectivity binds to VPAC1, VPAC2, or PAC1 and wherein the VIP analog of functional fragment thereof is an agonist or antagonist of at least one receptor chosen from: VPAC1, VPAC2, and PAC1. In some embodiments, the methods of treatment or prevention include administration of VIP analogs, wherein the VIP analog is an agonist or antagonist of at least one receptor chosen from: VPAC1, VPAC2, and PAC1. In some embodiments, the composition comprises an analog, wherein the analog wherein the analog comprises a repetitive pattern of sequential β-amino acids from the amino-terminus to the carboxy-terminus chosen from the following: αααααααβ, αααααβα, αααααβαα, αααβααα, ααβαααα, αβααααα, βααααααα, ααααααββ, ααααββα, αααββαα, ααββααα, αββαααα, ββααααα, βααααααβ, βαααααβα, βαααβαα, βααβααα, βαβαααα, αβααααβ, αβαααβα, αβααβαα, αβαβααα, ααβαααβ, ααβααβα, ααβαβα, ααβαβαα, αααβααβ, αααβαβα, and ααααβαβ. In some embodiments, the composition comprises an analog, wherein the analog comprises a repetitive pattern of sequential β-amino acids from the amino-terminus to the carboxy-terminus chosen from the following: βααβαααβααβαααβααα, βααβαααβααβαααββαα, βααβαααβααβαααββα, and βααβαααβααβαααβββ. In some embodiments, the composition comprises an analog, wherein the analog comprises a repetitive pattern of sequential β-amino acids from the amino-terminus to the carboxy-terminus chosen from the following:

ββαβαααβααβαααβααβ; βαββαααβααβαααβααβ;

βααββααβααβαααβααβ; βααβαβαβααβαααβααβ;

βααβααββααβαααβααβ; βααβαααββαβαααβααβ;

βααβαααβαββαααβααβ; βααβαααβααββααβααβ;

βααβαααβααβαβαβααβ; βααβαααβααβααββααβ;

βααβαααβααβαααββαβ;
and

βααβαααβααβαααβαββ.

In some embodiments, the composition comprises an analog, wherein the analog comprises a repetitive pattern of sequential β-amino acids from the amino-terminus to the carboxy-terminus chosen from the following:

ββαβααβααβαααβααβααα; βαβαβααβααβαααβααααα;

βααββααβααβαααβαααα; βαααββαβαααβααβαααα;

βααβαββααβααβαααα; βααβααββαβααβαααα;

βααβααβαβαβααβαααα; βααβααβααββααβαααα;

βααβααβαααββαβαααα; βααβααβαααβαββααα;

βααβααβαααβααββαα; βααβααβαααβααβαβα;
and

βααβααβαααβααβααβ.

In some embodiments, the composition comprises an analog, wherein the analog comprises a repetitive pattern of sequential β-amino acids from the amino-terminus to the carboxy-terminus chosen from the following: βααβαααβααβαααβααα, βααβαααβααβαααββαα, βααβαααβααβαααββα, and βααβαααβααβααββββ, wherein any α-amino acid residue may be a non-natural amino acid. In some embodiments, the composition comprises an analog, wherein the analog comprises a repetitive pattern of sequential β-amino acids from the amino-terminus to the carboxy-terminus chosen from the following: βααβαααβααβαααβααα, βααβαααβααβαααββαα, βααβαααβααβαααβββα, and βααβαααβααβαααββββ, wherein at least one α-amino acid residue may be a non-natural amino acid. In some embodiments, the composition comprises an analog, wherein the analog comprises a repetitive pattern of sequential β-amino acids from the amino-terminus to the carboxy-terminus chosen from the following: βααβαααβααβαααβααα, βααβαααβααβαααββαα, βααβαααβααβαααβββα, and βααβαααβααβαααββββ, wherein from about 1 to about 10 α-amino acid residues may be a non-natural amino acid. In any of the above-mentioned patterns one or more of the β-amino acid residues may be replaced or modified with cyclic β-amino acid (cyclically-constrained beta amino acid), such as APC or ACPC.

In some embodiments, the composition comprises a VIP analog, wherein the analog comprises the following repetitive pattern of sequential β-amino acids from the amino-terminus to the carboxy-terminus: βααβαααβααβαααβααβ. In some embodiments, the composition comprises a VIP analog, wherein the analog comprises the following repetitive pattern of sequential β-amino acids from the amino-terminus: $\beta_1\alpha_1\alpha_2\beta_2\alpha_3\alpha_4\alpha_5\beta_3\alpha_6\alpha_7\beta_4\alpha_8\alpha_9\alpha_{10}\beta_5\alpha_{11}\alpha_{12}\beta_6$, wherein $\beta_1$=any beta amino acid, $\alpha_1$=any alpha amino acid, $\alpha_2$=any alpha amino acid, $\beta_2$=any beta amino acid, $\alpha_3$=any alpha amino acid, $\alpha_4$=any alpha amino acid; $\alpha_5$=any alpha amino acid, $\beta_3$=any beta amino acid, $\alpha_6$=any alpha amino acid; $\alpha_7$=any alpha amino acid; $\beta_4$=any beta amino acid, $\alpha_8$=any alpha amino acid; $\alpha_9$=any alpha amino acid; $\alpha_{10}$=any alpha amino acid; $\beta_5$=any beta amino acid; $\alpha_{11}$=any alpha amino acid, $\alpha_{12}$=any alpha amino acid, $\beta_6$=any beta amino acid.

In some embodiments, the composition comprises a VIP analog, wherein the analog comprises the following repetitive pattern of sequential β-amino acids from the amino-terminus: $\beta_1\alpha_1\alpha_2\beta_2\alpha_3\alpha_4\alpha_5\beta_3\alpha_6\alpha_7\beta_4\alpha_8\alpha_9\alpha_{10}\beta_5\alpha_{11}\alpha_{12}\beta_6$, wherein $\beta_1$=any beta-3, beta-2, cyclic or heterocyclic beta-amino acid, $\alpha_1$=any alpha amino acid, $\alpha_2$=any alpha amino acid, $\beta_2$=any beta-3, beta-2, cyclic or heterocyclic beta-amino acid, $\alpha_3$=any alpha amino acid, $\alpha_4$=any alpha amino acid; $\alpha_5$=any alpha amino acid, $\beta_3$=any beta-3, beta-2, cyclic or heterocyclic beta-amino acid, $\alpha_6$=any alpha amino acid; $\alpha_7$=any alpha amino acid; $\beta_4$=any beta-3, beta-2, cyclic or heterocyclic beta-amino acid, $\alpha_8$=any alpha amino acid; $\alpha_9$=any alpha amino acid; $\alpha_{10}$=any alpha amino acid; $\beta_5$=any beta-3, beta-2, cyclic or heterocyclic beta-amino acid; $\alpha_{11}$=any alpha amino acid, $\alpha_{12}$=any alpha amino acid, $\beta_6$=any beta-3, beta-2, cyclic or heterocyclic beta-amino acid.

In some embodiments, the composition comprises a VIP analog, wherein the analog comprises the following repetitive pattern of sequential β-amino acids from the amino-terminus: $\beta_1\alpha_1\alpha_2\beta_2\alpha_3\alpha_4\alpha_5\beta_3\alpha_6\alpha_7\beta_4\alpha_8\alpha_9\alpha_{10}\beta_5\alpha_{11}\alpha_{12}\beta_6$, wherein $\beta_1$=any beta-3 amino acid, $\alpha_1$=any alpha amino acid, $\alpha_2$=any alpha amino acid, $\beta_2$=any beta-3 amino acid, $\alpha_3$=any alpha amino acid, $\alpha_4$=any alpha amino acid; $\alpha_5$=any alpha amino acid, $\beta_3$=any beta-3 amino acid, $\alpha_6$=any alpha amino acid; $\alpha_7$=any alpha amino acid; $\beta_4$=any beta-3 amino acid, $\alpha_8$=any alpha amino acid; $\alpha_9$=any alpha amino acid; $\alpha_{10}$=any alpha amino acid; $\beta_5$=any beta-3 amino acid; $\alpha_{11}$=any alpha amino acid, $\alpha_{12}$=any alpha amino acid, $\beta_6$=any beta-3 amino acid.

In some embodiments, the composition comprises a VIP analog, wherein the analog comprises the following repetitive pattern of sequential β-amino acids from the amino-terminus: $\beta_1\alpha_1\alpha_2\beta_2\alpha_3\alpha_4\alpha_5\beta_3\alpha_6\alpha_7\beta_4\alpha_8\alpha_9\alpha_{10}\beta_5\alpha_{11}\alpha_{12}\beta_6$, wherein $\beta_1$=any beta-2 amino acid, $\alpha_1$=any alpha amino acid, $\alpha_2$=any alpha amino acid, $\beta_2$=any beta-2 amino acid, $\alpha_3$=any alpha amino acid, $\alpha_4$=any alpha amino acid; $\alpha_5$=any alpha amino acid, $\beta_3$=any beta-2 amino acid, $\alpha_6$=any alpha amino acid; $\alpha_7$=any alpha amino acid; $\beta_4$=any beta-2 amino acid, $\alpha_8$=any alpha amino acid; $\alpha_9$=any alpha amino acid; $\alpha_{10}$=any alpha amino acid; $\beta_5$=any beta-2 amino acid; $\alpha_{11}$=any alpha amino acid; $\alpha_{12}$=any alpha amino acid; $\beta_6$=any beta-2 amino acid.

In some embodiments, the composition comprises a VIP analog, wherein the analog comprises the following repetitive pattern of sequential β-amino acids from the amino-terminus: $\beta_1\alpha_1\alpha_2\beta_2\alpha_3\alpha_4\alpha_5\beta_3\alpha_6\alpha_7\beta_4\alpha_8\alpha_9\alpha_{10}\beta_5\alpha_{11}\alpha_{12}\beta_6$, wherein $\beta_1$=any cyclic or heterocyclic beta-amino acid, $\alpha_1$=any alpha amino acid, $\alpha_2$=any alpha amino acid, $\beta_2$=any cyclic or heterocyclic beta-amino acid, $\alpha_3$=any alpha amino acid, $\alpha_4$=any alpha amino acid; $\alpha_5$=any alpha amino acid, $\beta_3$=cyclic or heterocyclic beta-amino acid, $\alpha_6$=any alpha amino acid; $\alpha_7$=any alpha amino acid; $\beta_4$=cyclic or heterocyclic beta-amino acid, $\alpha_8$=any alpha amino acid; $\alpha_9$=any alpha amino acid; $\alpha_{10}$=any alpha amino acid; $\beta_5$=cyclic or heterocyclic beta-amino acid, $\alpha_{11}$=any alpha amino acid, $\alpha_{12}$=any alpha amino acid, $\beta_6$=cyclic or heterocyclic beta-amino acid In some embodiments, the composition comprises a VIP analog, wherein the analog comprises the following repetitive pattern of sequential β-amino acids from the amino-terminus: $\beta_1\alpha_1\alpha_2\beta_2\alpha_3\alpha_4\alpha_5\beta_3\alpha_6\alpha_7\beta_4\alpha_8\alpha_9\alpha_{10}\beta_5\alpha_{11}\alpha_{12}\beta_6$, wherein $\beta_1$=any beta-3 amino acid, $\alpha_1$=any alpha amino acid, $\alpha_2$=any alpha amino acid, $\beta_2$=any beta-3 amino acid, $\alpha_3$=any alpha amino acid, $\alpha_4$=any alpha amino acid; $\alpha_5$=any alpha amino acid, $\beta_3$=any beta-3 amino acid, $\alpha_6$=any alpha amino acid; $\alpha_7$=any alpha amino acid; $\beta_4$=any beta-3 amino acid, $\alpha_8$=any alpha amino acid; $\alpha_9$=any alpha amino acid; $\alpha_{10}$=any alpha amino acid; $\beta_5$=a beta-3 alanine; $\alpha_{11}$=any alpha amino acid, $\alpha_{12}$=any alpha amino acid, $\beta_6$=any beta-3 amino acid.

In some embodiments, the composition comprises a VIP analog, wherein the analog comprises the following repetitive pattern of sequential β-amino acids from the amino-terminus: $\beta_1\alpha_1\alpha_2\beta_2\alpha_3\alpha_4\alpha_5\beta_3\alpha_6\alpha_7\beta_4\alpha_8\alpha_9\alpha_{10}\beta_5\alpha_{11}\alpha_{12}\beta_6$, wherein $\beta_1$=any beta-3 amino acid, $\alpha_1$=any alpha amino acid, $\alpha_2$=any alpha amino acid, $\beta_2$=any beta-3 amino acid, $\alpha_3$=any alpha amino acid, $\alpha_4$=any alpha amino acid; $\alpha_5$=an alpha leucine, $\beta_3$=any beta-3 amino acid, $\alpha_6$=any alpha amino acid; $\alpha_7$=any alpha amino acid; $\beta_4$=any beta-3 amino acid, $\alpha_8$=any alpha amino acid; $\alpha_9$=any alpha amino acid; $\alpha_{10}$=any alpha amino acid; $\beta_5$=a beta-3 alanine; $\alpha_{11}$=any alpha amino acid, $\alpha_{12}$=any alpha amino acid, $\beta_6$=any beta-3 amino acid.

In some embodiments, the composition comprises a VIP analog, wherein the analog comprises the following repetitive pattern of sequential β-amino acids from the amino-terminus: $\beta_1\alpha_1\alpha_2\beta_2\alpha_3\alpha_4\alpha_5\beta_3\alpha_6\alpha_7\beta_4\alpha_8\alpha_9\alpha_{10}\beta_5\alpha_{11}\alpha_{12}\beta_6$, wherein $\beta_1$=any beta-3 amino acid, $\alpha_1$=any alpha amino acid, $\alpha_2$=any alpha amino acid, $\beta_2$=any beta-3 amino acid, $\alpha_3$=any alpha amino acid, $\alpha_4$=any alpha amino acid; $\alpha_5$=an alpha leucine, $\beta_3$=any beta-3 amino acid, $\alpha_6$=any alpha amino acid; $\alpha_7$=any alpha amino acid; $\beta_4$=any beta-3 amino acid, $\alpha_8$=any alpha amino acid; $\alpha_9$=any alpha amino acid; $\alpha_{10}$=any alpha amino acid; $\beta_5$=a beta-3 amino acid; $\alpha_{11}$=any alpha amino acid, $\alpha_{12}$=any alpha amino acid, $\beta_6$=any beta-3 amino acid.

In some embodiments, the composition comprises a VIP analog, wherein the analog comprises the following repetitive pattern of sequential β-amino acids from the amino-terminus: $\alpha_1\alpha_2\beta_2\alpha_3\alpha_4\alpha_5\beta_3\alpha_6\alpha_7\beta_4\alpha_8\alpha_9\alpha_{10}\beta_5\alpha_{11}\alpha_{12}\beta_6$, wherein $\beta_2$=a beta 3-threonine, $\alpha_1$=any alpha amino acid, $\alpha_2$=any alpha amino acid, $\beta_2$=a beta-3 arginine, $\alpha_3$=any alpha amino acid, $\alpha_4$=any alpha amino acid; $\alpha_5$=any alpha amino acid, $\beta_3$=a beta-3 alanine, $\alpha_6$=any alpha amino acid; $\alpha_7$=any alpha amino acid; $\beta_4$=a beta-3 lysine, $\alpha_8$=any alpha amino acid; $\alpha_9$=any alpha amino acid; $\alpha_{10}$=any alpha amino acid; $\beta_5$=a beta-3 alanine; $\alpha_{11}$=any alpha amino acid, $\alpha_{12}$=any alpha amino acid, $\beta_6$=a beta-3 asparagine.

In some embodiments, the composition comprises a VIP analog, wherein the analog comprises the following repetitive pattern of sequential β-amino acids from the amino-terminus: $\beta_1\alpha_1\alpha_2\beta_2\alpha_3\alpha_4\alpha_5\beta_3\alpha_6\alpha_7\beta_4\alpha_8\alpha_9\alpha_{10}\beta_5\alpha_{11}\alpha_{12}\beta_6$, wherein $\beta_2$=a beta 3-threonine, $\alpha_1$=any alpha amino acid, $\alpha_2$=any alpha amino acid, $\beta_2$=a beta-3 arginine, $\alpha_3$=any alpha amino acid, $\alpha_4$=any alpha amino acid; $\alpha_5$=an alpha leucine, $\beta_3$=a beta-3 alanine, $\alpha_6$=any alpha amino acid; $\alpha_7$=any alpha amino acid; $\beta_4$=a beta-3 lysine, $\alpha_8$=any alpha amino acid; $\alpha_9$=any alpha amino acid; $\alpha_{10}$=any alpha amino acid; $\beta_5$=a beta-3 alanine; $\alpha_{11}$=any alpha amino acid, $\alpha_{11}$=any alpha amino acid, $\beta_6$=a beta-3 asparagine.

In some embodiments, the composition comprises a VIP analog, wherein the analog comprises the following repetitive pattern of sequential β-amino acids from the amino-terminus: $\beta_1\alpha_1\alpha_2\beta_2\alpha_3\alpha_4\alpha_5\beta_3\alpha_6\alpha_7\beta_4\alpha_8\alpha_9\alpha_{10}\beta_5\alpha_{11}\alpha_{12}\beta_6$, wherein $\beta_2$=any beta amino acid, $\alpha_1$=an alpha arginine, $\alpha_2$=an alpha leucine, $\beta_2$=any beta amino acid, $\alpha_3$=an alpha lysine, $\alpha_4$=an alpha glutamine; $\alpha_5$=an alpha-leucine, $\beta_3$=any beta amino acid; $\alpha_6$=an alpha valine; $\alpha_7$=an alpha lysine; $\beta_4$=any beta amino acid, $\alpha_8$=an alpha tyrosine; $\alpha_9$=an alpha leucine; $\alpha_{10}$=an alpha asparagine; $\beta_5$=a beta-3 alanine; $\alpha_{11}$=an alpha isoleucine, $\alpha_{22}$=an alpha leucine, $\beta_6$=any beta amino acid.

In some embodiments, the composition comprises a VIP analog, wherein the analog comprises the following repetitive pattern of sequential β-amino acids from the amino-terminus: $\beta_1\alpha_1\alpha_2\beta_2\alpha_3\alpha_4\alpha_5\beta_3\alpha_6\alpha_7\beta_4\alpha_8\alpha_9\alpha_{10}\beta_5\alpha_{11}\alpha_{12}\beta_6$, wherein $\beta_1$=any beta-3 amino acid, $\alpha_1$=an alpha arginine, $\alpha_2$=an alpha leucine, $\beta_2$=any beta-3 amino acid, $\alpha_3$=an alpha lysine, $\alpha_4$=an alpha glutamine; $\alpha_5$=an alpha leucine, $\beta_3$=any beta-3 amino acid; $\alpha_6$=an alpha valine; $\alpha_7$=an alpha lysine; $\beta_4$=any beta-3 amino acid, $\alpha_8$=an alpha tyrosine; $\alpha_9$=an alpha leucine; $\alpha_{10}$=an alpha asparagine; $\beta_5$=any beta-3 amino acid; $\alpha_{13}$=an alpha isoleucine, $\alpha_{12}$=an alpha leucine, $\beta_6$=any beta amino acid.

In some embodiments, the composition comprises a VIP analog, wherein the analog comprises the following repetitive pattern of sequential β-amino acids from the amino-terminus: $\beta_1\alpha_1\alpha_2\beta_2\alpha_3\alpha_4\alpha_5\beta_3\alpha_6\alpha_7\beta_4\alpha_8\alpha_9\alpha_{10}\beta_5\alpha_{11}\alpha_{12}\beta_6$, wherein $\beta_2$=a beta-2 threonine; $\alpha_1$=an alpha arginine, $\alpha_2$=an alpha leucine, $\beta_2$=a beta-2 arginine, $\alpha_3$=an alpha lysine, $\alpha_4$=an alpha glutamine; $\alpha_5$=an alpha leucine, $\beta_3$=a beta-2 alanine, $\alpha_6$=an alpha valine; $\alpha_7$=an alpha lysine; $\beta_4$=a beta-2 lysine, $\alpha_8$=an alpha tyrosine; $\alpha_9$=an alpha leucine; $\alpha_{10}$=an alpha asparagine; $\beta_5$=a beta-2 alanine; $\alpha_{11}$=an alpha isoleucine, $\alpha_{12}$=an alpha leucine, $\beta_6$=a beta-2 asparagine.

In some embodiments, the composition comprises a VIP analog, wherein the analog comprises the following repetitive pattern of sequential β-amino acids from the amino-terminus: $\beta_1\alpha_1\alpha_2\beta_2\alpha_3\alpha_4\alpha_5\beta_3\alpha_6\alpha_7\beta_4\alpha_8\alpha_9\alpha_{10}\beta_5\alpha_{11}\alpha_{12}\beta_6$, wherein $\beta_2$=a beta-3 threonine or ACPC; $\alpha_1$=an alpha arginine, $\alpha_2$=an alpha leucine, $\beta_2$=a beta-3 arginine or APC, $\alpha_3$=an alpha lysine, $\alpha_4$=an alpha glutamine; $\alpha_5$=an alpha leucine, $\beta_3$=a beta-3 alanine or ACPC, $\alpha_6$=an alpha valine; $\alpha_7$=an alpha lysine; $\beta_4$=a beta-3 lysine or APC, $\alpha_8$=an alpha tyrosine; $\alpha_9$=an alpha leucine; $\alpha_{10}$=an alpha asparagine; $\beta_5$=a beta-3 alanine or ACPC; $\alpha_{11}$=an alpha isoleucine, $\alpha_{22}$=an alpha leucine, $\beta_6$=a beta-3 asparagine.

In some embodiments, the composition comprises a VIP analog, wherein the analog comprises the following repetitive pattern of sequential β-amino acids from the amino-terminus: $\beta_1\alpha_1\alpha_2\alpha_3\beta_2\alpha_4\alpha_5\beta_3\alpha_6\alpha_7\alpha_8\beta_4\alpha_9\alpha_{10}\beta_5\alpha_{11}\alpha_{12}\alpha_{13}$, wherein $\beta_2$=any beta amino acid; $\alpha_1$=any alpha amino acid, $\alpha_2$=any alpha amino acid, $\alpha_3$=any alpha amino acid, $\beta_2$=any beta amino acid; $\alpha_4$=any alpha amino acid, $\alpha_5$=any alpha amino acid, $\beta_3$=any beta amino acid; α6=any alpha amino acid, $\alpha_7$=any alpha amino acid, $\alpha_8$=any alpha amino acid, $\beta_4$=any beta amino acid; $\alpha_9$=any alpha amino acid, $\alpha_{10}$=any alpha amino acid, $\beta_5$=any beta amino acid; $\alpha_{11}$=any alpha amino acid, $\alpha_{12}$=any alpha amino acid, $\alpha_{13}$=any alpha amino acid.

In some embodiments, the composition comprises a VIP analog, wherein the analog comprises the following repetitive pattern of sequential β-amino acids from the amino-terminus: $\beta_1\alpha_1\alpha_2\alpha_3\beta_2\alpha_4\alpha_5\beta_3\alpha_6\alpha_7\alpha_8\beta_4\alpha_9\alpha_{10}\beta_5\alpha_{11}\alpha_{12}\alpha$—, wherein $\beta_1$=any beta-3, beta-2, cyclic or heterocyclic beta-amino acid; $\alpha_1$=any alpha amino acid, $\alpha_2$=any alpha amino acid, $\alpha_3$=any alpha amino acid, $\beta_2$=any beta-3, beta-2, cyclic or heterocyclic beta-amino acid; $\alpha_4$=any alpha amino acid, $\alpha_5$=any alpha amino acid, $\beta_3$=any beta-3, beta-2, cyclic or heterocyclic beta-amino acid; α6=any alpha amino acid, α7=any alpha amino acid, α8=any alpha amino acid, $\beta_4$=any beta-3, beta-2, cyclic or heterocyclic beta-amino acid; $\alpha_9$=any alpha amino acid, $\alpha_{10}$=any alpha amino acid, $\beta_5$=any beta-3, beta-2, cyclic or heterocyclic beta-amino acid; $\alpha_{11}$=any alpha amino acid, $\alpha_{12}$=any alpha amino acid, $\alpha_{13}$=any alpha amino acid.

In some embodiments, the composition comprises a VIP analog, wherein the analog comprises the following repetitive pattern of sequential β-amino acids from the amino-terminus: $\beta_1\alpha_1\alpha_2\alpha_3\beta_2\alpha_4\alpha_5\beta_3\alpha_6\alpha_7\alpha_8\beta_4\alpha_9\alpha_{10}\beta_5\alpha_{11}\alpha_{12}\alpha_{13}$, wherein $\beta_1$=any beta-3 amino acid; $\alpha_1$=any alpha amino acid, $\alpha_2$=any alpha amino acid, $\alpha_3$=any alpha amino acid, $\beta_2$=any beta-3 amino acid; $\alpha_4$=any alpha amino acid, $\alpha_5$=any alpha amino acid, $\beta_3$=any beta-3 amino acid; α6=any alpha amino acid, α7=any alpha amino acid, α8=any alpha amino acid, $\beta_4$=any beta-3 amino acid; $\alpha_9$=any alpha amino acid, $\alpha_{10}$=any alpha amino acid, $\beta_5$=any beta-3 amino acid; $\alpha_{11}$=any alpha amino acid, $\alpha_{12}$=any alpha amino acid, $\alpha_{13}$=any alpha amino acid.

In some embodiments, the composition comprises a VIP analog, wherein the analog comprises the following repetitive pattern of sequential β-amino acids from the amino-terminus: $\beta_1\alpha_1\alpha_2\alpha_3\beta_2\alpha_4\alpha_5\beta_3\alpha_6\alpha_7\alpha_8\beta_4\alpha_9\alpha_{10}\beta_5\alpha_{11}\alpha_{12}\alpha_{13}$, wherein $\beta_1$=any beta-2 amino acid; $\alpha_1$=any alpha amino acid, $\alpha_2$=any alpha amino acid, $\alpha_3$=any alpha amino acid, $\beta_2$=any beta-2 amino acid; $\alpha_4$=any alpha amino acid, $\alpha_5$=any alpha amino acid, $\beta_3$=any beta-2 amino acid; α6=any alpha amino acid, α7=any alpha amino acid, α8=any alpha amino acid, $\beta_4$=any beta-2 amino acid; $\alpha_9$=any alpha amino acid, $\alpha_{10}$=any alpha amino acid, $\beta_5$=any beta-2 amino acid; $\alpha_{11}$=any alpha amino acid, $\alpha_{12}$=any alpha amino acid, $\alpha_{13}$=any alpha amino acid.

In some embodiments, the composition comprises a VIP analog, wherein the analog comprises the following repetitive pattern of sequential β-amino acids from the amino-terminus: $\beta_1\alpha_1\alpha_2\alpha_3\beta_2\alpha_4\alpha_5\beta_3\alpha_6\alpha_7\alpha_8\beta_4\alpha_9\alpha_{10}\beta_5\alpha_{11}\alpha_{12}\alpha_{13}$, wherein $\beta_1$=any cyclic or heterocyclic beta-amino acid; $\alpha_1$=any alpha amino acid, $\alpha_2$=any alpha amino acid, $\alpha_3$=any alpha amino acid, $\beta_2$=any cyclic or heterocyclic beta-amino acid; $\alpha_4$=any alpha amino acid, $\alpha_5$=any alpha amino acid, $\beta_3$=any cyclic or heterocyclic beta-amino acid; α6=any alpha amino acid, α7=any alpha amino acid, α8=any alpha amino acid, $\beta_4$=any cyclic or heterocyclic beta-amino acid; $\alpha_9$=any alpha amino acid, $\alpha_{10}$=any alpha amino acid, $\beta_5$=any cyclic or heterocyclic beta-amino acid; $\alpha_{13}$=any alpha amino acid, $\alpha_{12}$=any alpha amino acid, $\alpha_{13}$=any alpha amino acid.

In some embodiments, the composition comprises a VIP analog, wherein the analog comprises the following repetitive pattern of sequential β-amino acids from the amino-terminus: $\beta_1\alpha_1\alpha_2\alpha_3\beta_2\alpha_4\alpha_5\beta_3\alpha_6\alpha_7\alpha_8\beta_4\alpha_9\alpha_{10}\beta_5\alpha_{11}\alpha_{12}\alpha_{13}$, wherein $\beta_1$=a beta-3 threonine; $\alpha_1$=any alpha amino acid, $\alpha_2$=any alpha amino acid, $\alpha_3$=any alpha amino acid, $\beta_2$=a beta-3 lysine; $\alpha_4$=any alpha amino acid, $\alpha_5$=any alpha amino acid, $\beta_3$=a beta-3 alanine; α6=any alpha amino acid, α7=any alpha amino acid, α8=any alpha amino acid, $\beta_4$=a beta-3 tyrosine; $\alpha_9$=any alpha amino acid, $\alpha_{10}$=any alpha amino acid, $\beta_5$=a beta-3 alanine; $\alpha_{11}$=any alpha amino acid, $\alpha_{12}$=any alpha amino acid, $\alpha_{13}$=any alpha amino acid.

In some embodiments, the composition comprises a VIP analog, wherein the analog comprises the following repetitive pattern of sequential β-amino acids from the amino-terminus: $\beta_1\alpha_1\alpha_2\alpha_3\beta_2\alpha_4\alpha_5\beta_3\alpha_6\alpha_7\alpha_8\beta_4\alpha_9\alpha_{10}\beta_5\alpha_{11}\alpha_{12}\alpha13$; wherein $\beta_1$=any beta amino acid; $\alpha_1$=an alpha arginine, $\alpha_2$=an alpha leucine, $\alpha_3$=an alpha arginine, $\beta_2$=any beta amino acid; $\alpha_4$=an alpha glutamine, $\alpha_5$=an alpha leucine, $\beta_3$=any beta amino acid; $\alpha_6$=an alpha valine acid, $\alpha_7$=an alpha lysine, $\alpha_8$=an alpha lysine, $\beta_4$=any beta amino acid; $\alpha_9$=an alpha leucine, $\alpha_{10}$=an alpha asparagine, $\beta_5$=any beta amino acid; $\alpha_{11}$=an alpha isoleucine, $\alpha_{12}$=an alpha leucine, $\alpha_{13}$=an alpha asparagine.

In some embodiments, the composition comprises a VIP analog, wherein the analog comprises the following repetitive pattern of sequential β-amino acids from the amino-terminus: $\beta_1\alpha_1\alpha_2\alpha_3\beta_2\alpha_4\alpha_5\beta_3\alpha_6\alpha_7\alpha_8\beta_4\alpha_9\alpha_{10}\beta_5\alpha_{11}\alpha_{12}\alpha_{13}$; wherein $\beta_1$=any beta-3 amino acid; $\alpha_1$=an alpha arginine, $\alpha_2$=an alpha leucine, $\alpha_3$=an alpha arginine, $\beta_2$=any beta-3 amino acid; $\alpha_4$=an alpha glutamine, $\alpha_5$=an alpha leucine, $\beta_3$=any beta-3 amino acid; $\alpha_6$=an alpha valine acid, $\alpha_7$=an alpha lysine, $\alpha_8$=an alpha lysine, $\beta_4$=any beta-3 amino acid; $\alpha_9$=an alpha leucine, $\alpha_1 p$=an alpha asparagine, $\beta_5$=any beta-3 amino acid; $\alpha_{11}$=an alpha isoleucine, $\alpha_{12}$=an alpha leucine, $\alpha_{13}$=an alpha asparagine.

In some embodiments, the composition comprises a VIP analog, wherein the analog comprises the following repetitive pattern of sequential β-amino acids from the amino-terminus: $\beta_1\alpha_1\alpha_2\alpha_3\beta_2\alpha_4\alpha_5\beta_3\alpha_6\alpha_7\alpha_8\beta_4\alpha_9\alpha_{10}\beta_5\alpha_{11}\alpha_{12}\alpha_{13}$; wherein $\beta_1$=any beta-2 amino acid; $\alpha_1$=an alpha arginine, $\alpha_2$=an alpha leucine, $\alpha_3$=an alpha arginine, $\beta_2$=any beta-2 amino acid; $\alpha_4$=an alpha glutamine, $\alpha_5$=an alpha leucine, $\beta_3$=any beta-2 amino acid; $\alpha_6$=an alpha valine acid, $\alpha_7$=an alpha lysine, $\alpha_8$=an alpha lysine, $\beta_4$=any beta-2 amino acid; $\alpha_9$=an alpha leucine, $\alpha_1 p$=an alpha asparagine, $\beta_5$=any beta-2 amino acid; $\alpha_{11}$=an alpha isoleucine, $\alpha_{12}$=an alpha leucine, $\alpha_{13}$=an alpha asparagine.

In some embodiments, the composition comprises a VIP analog, wherein the analog comprises the following repetitive pattern of sequential β-amino acids from the amino-terminus: $\beta_1\alpha_1\alpha_2\alpha_3\beta_2\alpha_4\alpha_5\beta_3\alpha_6\alpha_7\alpha_8\beta_4\alpha_9\alpha_{10}\beta_5\alpha_{11}\alpha_{12}\alpha_{13}$; wherein $\beta_1$=any cyclic and heterocyclic beta amino acid; $\alpha_1$=an alpha arginine, $\alpha_2$=an alpha leucine, $\alpha_3$=an alpha arginine, $\beta_2$=any cyclic and heterocyclic beta amino acid; $\alpha_4$=an alpha glutamine, $\alpha_5$=an alpha leucine, $\beta_3$=any cyclic and heterocyclic beta amino acid; $\alpha_6$=an alpha valine acid, $\alpha_7$=an alpha lysine, $\alpha_8$=an alpha lysine, $\beta_4$=any cyclic and heterocyclic beta amino acid; $\alpha_9$=an alpha leucine, $\alpha_1 p$=an alpha asparagine, $\beta_5$=any cyclic and heterocyclic beta amino acid; $\alpha_{11}$=an alpha isoleucine, $\alpha_{12}$=an alpha leucine, $\alpha_{13}$=an alpha asparagine.

In some embodiments, the composition comprises a VIP analog, wherein the analog comprises the following repetitive pattern of sequential β-amino acids from the amino-terminus: $\beta_1\alpha_1\alpha_2\alpha_3\beta_2\alpha_4\alpha_5\beta_3\alpha_6\alpha_7\alpha_8\beta_4\alpha_9\alpha_{10}\beta_5\alpha_{11}\alpha_{12}\alpha_{13}$, wherein $\beta_1$=a beta-3 threonine or an ACPC; $\alpha_1$=an alpha arginine, $\alpha_2$=an alpha leucine, $\alpha_3$=an alpha arginine, $\beta_2$=a beta-3 lysine or APC; $\alpha_4$=an alpha glutamine, $\alpha_5$=an alpha leucine, $\beta_3$=a beta-3 alanine or ACPC; $\alpha_6$=an alpha valine acid, $\alpha_7$=an alpha lysine, $\alpha_8$=an alpha lysine, $\beta_4$=a beta-3 tyrosine or; $\alpha_9$=an alpha leucine, $\alpha_{1p}$=an alpha asparagine, $\beta_5$=a beta-3 alanine or ACPC; $\alpha_{11}$=an alpha isoleucine, $\alpha_{12}$=an alpha leucine, $\alpha_{13}$=an alpha asparagine.

In some embodiments, the composition comprises a VIP analog, wherein the analog comprises the following repetitive pattern of sequential β-amino acids from the amino-terminus: $\beta_1\alpha_1\alpha_2\alpha_3\beta_2\alpha_4\alpha_5\beta_3\alpha_6\alpha_7\alpha_8\beta_4\alpha_9\alpha_{10}\beta_5\alpha_{11}\alpha_{12}\alpha_{13}\beta_6$; wherein $\beta_1$=any beta amino acid; $\alpha_1$=any alpha amino acid, $\alpha_2$=any alpha amino acid, $\alpha_3$=an alpha amino acid, $\beta_2$=any beta amino acid; $\alpha_4$=an alpha alpha amino acid, $\alpha_5$=any alpha amino acid, $\beta_3$=any beta amino acid; $\alpha_6$=any alpha amino acid, $\alpha_7$=any alpha amino acid, $\alpha_8$=any alpha amino acid, $\beta_4$=any beta amino acid; $\alpha_9$=any alpha amino acid, $\alpha_{10}$=any alpha amino acid, $\beta_5$=any beta amino acid; $\alpha_{11}$=any alpha amino acid, $\alpha_{12}$=any alpha amino acid, $\alpha_{13}$=any alpha amino acid; and $\beta_6$=any beta amino acid.

In some embodiments, the composition comprises a VIP analog, wherein the analog comprises the following repetitive pattern of sequential β-amino acids from the amino-terminus: $\beta_1\alpha_1\alpha_2\alpha_3\beta_2\alpha_4\alpha_5\beta_3\alpha_6\alpha_7\alpha_8\beta_4\beta_9\alpha_{10}\beta_5\alpha_{11}\alpha_{12}\alpha_{13}\beta_6$; wherein $\beta_1$=any beta-3, beta-2, cyclic or heterocyclic beta-amino acid; $\alpha_1$=any alpha amino acid, $\alpha_2$=any alpha amino acid, $\alpha_3$=an alpha amino acid, $\beta_2$=any beta-3, beta-2, cyclic or heterocyclic beta-amino acid; $\alpha_4$=an alpha alpha amino acid, $\alpha_5$=any alpha amino acid, $\beta_3$=any beta-3, beta-2, cyclic or heterocyclic beta-amino acid; $\alpha_6$=any alpha amino acid, $\alpha_7$=any alpha amino acid, $\alpha_8$=any alpha amino acid, $\beta_4$=any beta-3, beta-2, cyclic or heterocyclic beta-amino acid; $\alpha_9$=any alpha amino acid, $\alpha_{10}$=any alpha amino acid, $\beta_5$=any beta-3, beta-2, cyclic or heterocyclic beta-amino acid; $\alpha_{11}$=any alpha amino acid, $\alpha_{12}$=any alpha amino acid, $\alpha_{13}$=any alpha amino acid; and $\beta_6$=any beta-3, beta-2, cyclic or heterocyclic beta-amino acid.

In some embodiments, the composition comprises a VIP analog, wherein the analog comprises the following repetitive pattern of sequential β-amino acids from the amino-terminus: $\beta_1\alpha_1\alpha_2\alpha_3\beta_2\alpha_4\alpha_5\beta_3\alpha_6\alpha_7\alpha_8\beta_4\alpha_9\alpha_{10}\beta_5\alpha_{11}\alpha_{12}\alpha_{13}\beta_6$; wherein $\beta_1$=any beta-3 amino acid; $\alpha_1$=any alpha amino acid, $\alpha_2$=any alpha amino acid, $\alpha_3$=an alpha amino acid, $\beta_2$=any beta-3 amino acid; $\alpha_4$=an alpha alpha amino acid, $\alpha_5$=any alpha amino acid, $\beta_3$=any beta-3 amino acid; $\alpha_6$=any alpha amino acid, $\alpha_7$=any alpha amino acid, $\alpha_8$=any alpha amino acid, $\beta_4$=any beta-3 amino acid; $\alpha_9$=any alpha amino acid, $\alpha_{10}$=any alpha amino acid, $\beta_5$=any beta-3 amino acid; $\alpha_{11}$=any alpha amino acid, $\alpha_{12}$=any alpha amino acid, $\alpha_{13}$=any alpha amino acid; and $\beta_6$=any beta-3 amino acid.

In some embodiments, the composition comprises a VIP analog, wherein the analog comprises the following repetitive pattern of sequential β-amino acids from the amino-terminus: $\beta_1\alpha_1\alpha_2\alpha_3\beta_2\alpha_4\alpha_5\beta_3\alpha_6\alpha_7\alpha_8\beta_4\alpha_9\alpha_{10}\beta_5\alpha_{11}\beta_{12}\alpha_{13}\beta_6$; wherein $\beta_1$=any beta-2 amino acid; $\alpha_1$=any alpha amino acid, $\alpha_2$=any alpha amino acid, $\alpha_3$=an alpha amino acid, $\beta_2$=any beta-2 amino acid; $\alpha_4$=an alpha alpha amino acid, $\alpha_5$=any alpha amino acid, $\beta_3$=any beta-2 amino acid;

$\alpha_6$=any alpha amino acid, $\alpha_7$=any alpha amino acid, $\alpha_8$=any alpha amino acid, $\beta_4$=any beta-2 amino acid; $\alpha_9$=any alpha amino acid, $\alpha_{10}$=any alpha amino acid, P5=any beta-2 amino acid; $\alpha_{11}$=any alpha amino acid, $\alpha_{12}$=any alpha amino acid, $\alpha_{13}$=any alpha amino acid; and $\beta_6$=any beta-2 amino acid.

In some embodiments, the composition comprises a VIP analog, wherein the analog comprises the following repetitive pattern of sequential β-amino acids from the amino-terminus:

$\beta_1\alpha_1\alpha_2\alpha_3\beta_2\alpha_4\alpha_5\beta_3\alpha_6\alpha_7\alpha_8\beta_4\alpha_9\alpha_{10}\beta_5\alpha_{11}\alpha_{12}\alpha_{13}\beta_6$;

wherein $\beta_1$=any cyclic or heterocyclic beta-amino acid; $\alpha_1$=any alpha amino acid, $\alpha_2$=any alpha amino acid, $\alpha_3$=an alpha amino acid, $\beta_2$=any cyclic or heterocyclic beta-amino acid; $\alpha_4$=an alpha alpha amino acid, $\alpha_5$=any alpha amino acid, $\beta_3$=any cyclic or heterocyclic beta-amino acid; $\alpha_6$=any alpha amino acid, $\alpha_7$=any alpha amino acid, $\alpha_8$=any alpha amino acid, $\beta_4$=any cyclic or heterocyclic beta-amino acid; $\alpha_9$=any alpha amino acid, $\alpha_{10}$=any alpha amino acid, P5=any cyclic or heterocyclic beta-amino acid; $\alpha_{11}$=any alpha amino acid, $\alpha_{12}$=any alpha amino acid, $\alpha_{13}$=any alpha amino acid; and $\beta_6$=any cyclic or heterocyclic beta-amino acid. In some embodiments, the composition comprises a VIP analog, wherein the analog comprises the following repetitive pattern of sequential β-amino acids from the amino-terminus:

$\beta_1\alpha_1\alpha_2\alpha_3\beta_2\alpha_4\alpha_5\beta_3\alpha_6\alpha_7\alpha_8\beta_4\alpha_9\alpha_{10}\beta_5\alpha_{11}\alpha_{12}\alpha_{13}\beta_6$;

wherein $\beta_1$=a beta-2 tyrosine; $\alpha_1$=any alpha amino acid, $\alpha_2$=any alpha amino acid, $\alpha_3$=an alpha amino acid, $\beta_2$=a beta-2 arginine; $\alpha_4$=an alpha alpha amino acid, $\alpha_5$=any alpha amino acid, $\beta_3$=a beta-2 leucine; $\alpha_6$=any alpha amino acid, $\alpha_7$=any alpha amino acid, $\alpha_8$=any alpha amino acid, $\beta_4$=a beta-2 lysine; $\alpha_9$=any alpha amino acid, $\alpha_{10}$=any alpha amino acid, $\beta_5$=a beta-2 asparagine; $\alpha_{11}$=any alpha amino acid, $\alpha_{12}$=any alpha amino acid, $\alpha_{13}$=any alpha amino acid; and $\beta_6$=a beta-2 asparagine.

In some embodiments, the composition comprises a VIP analog, wherein the analog comprises the following repetitive pattern of sequential β-amino acids from the amino-terminus:

$\beta_1\alpha_1\alpha_2\alpha_3\beta_2\alpha_4\alpha_5\beta_3\alpha_6\alpha_7\alpha_8\beta_4\alpha_9\alpha_{10}\beta_5\alpha_{11}\alpha_{12}\alpha_{13}\beta_6$;

wherein $\beta_1$=a beta-3 tyrosine; $\alpha_1$=any alpha amino acid, $\alpha_2$=any alpha amino acid, $\alpha_3$=an alpha amino acid, $\beta_2$=a beta-3 arginine; $\alpha_4$=an alpha alpha amino acid, $\alpha_5$=any alpha amino acid, $\beta_3$=a beta-3 leucine; $\alpha_6$=any alpha amino acid, $\alpha_7$=any alpha amino acid, $\alpha_8$=any alpha amino acid, $\beta_4$=a beta-3 lysine; $\alpha_9$=any alpha amino acid, $\alpha_{10}$=any alpha amino acid, $\beta_5$=a beta-3 asparagine; $\alpha_{11}$=any alpha amino acid, $\alpha_{12}$=any alpha amino acid, $\alpha_{13}$=any alpha amino acid; and $\beta_6$=a beta-3 asparagine.

In some embodiments, the composition comprises a VIP analog, wherein the analog comprises the following repetitive pattern of sequential β-amino acids from the amino-terminus:

$\beta_1\alpha_1\alpha_2\alpha_3\beta_2\alpha_4\alpha_5\beta_3\alpha_6\alpha_7\alpha_8\beta_4\alpha_9\alpha_{10}\beta_5\alpha_{11}\alpha_{12}\alpha_{13}\beta_6$;

wherein $\beta_1$=any beta amino acid; $\alpha_1$=an alpha threonine, $\alpha_2$=an alpha arginine, $\alpha_3$=an alpha leucine, $\beta_2$=any beta amino acid; $\alpha_4$=an alpha lysine, $\alpha_5$=an alpha glutamine, $\beta_3$=any beta amino acid; $\alpha_6$=an alpha alanine, $\alpha_7$=an alpha valine, $\alpha_8$=an alpha lysine, $\beta_4$=any beta amino acid; $\alpha_9$=an alpha tyrosine; $\alpha_{10}$=an alpha leucine, $\beta_5$=any beta amino acid; $\alpha_{11}$=an alpha alanine, $\alpha_{12}$=an alpha isoleucine, $\alpha_{13}$=an alpha leucine; and $\beta_6$=any beta amino acid.

In some embodiments, the composition comprises a VIP analog, wherein the analog comprises the following repetitive pattern of sequential β-amino acids from the amino-terminus:

$\beta_1\alpha_1\alpha_2\alpha_3\beta_2\alpha_4\alpha_5\beta_3\alpha_6\alpha_7\alpha_8\beta_4\alpha_9\alpha_{10}\beta_5\alpha_{11}\alpha_{12}\alpha_{13}\beta_6$;

wherein $\beta_1$=any beta-3 amino acid; $\alpha_1$=an alpha threonine, $\alpha_2$=an alpha arginine, $\alpha_3$=an alpha leucine, $\beta_2$=any beta-3 amino acid; $\alpha_4$=an alpha lysine, $\alpha_5$=an alpha glutamine, $\beta_3$=any beta-3 amino acid; $\alpha_6$=an alpha alanine, $\alpha_7$=an alpha valine, $\alpha_8$=an alpha lysine, $\beta_4$=any beta-3 amino acid; $\alpha_9$=an alpha tyrosine; $\alpha_{10}$=an alpha leucine, $\beta_5$=any beta-3 amino acid; $\alpha_{11}$=an alpha alanine, $\alpha_{12}$=an alpha isoleucine, $\alpha_{13}$=an alpha leucine; and $\beta_6$=any beta-3 amino acid.

In some embodiments, the composition comprises a VIP analog, wherein the analog comprises the following repetitive pattern of sequential β-amino acids from the amino-terminus:

$\beta_1\alpha_1\alpha_2\alpha_3\beta_2\alpha_4\alpha_5\beta_3\alpha_6\alpha_7\alpha_8\beta_4\alpha_9\alpha_{10}\beta_5\alpha_{11}\alpha_{12}\alpha_{13}\beta_6$;

wherein $\beta_1$=any beta-2 amino acid; $\alpha_1$=an alpha threonine, $\alpha_2$=an alpha arginine, $\alpha_3$=an alpha leucine, $\beta_2$=any beta-2 amino acid; $\alpha_4$=an alpha lysine, $\alpha_5$=an alpha glutamine, $\beta_3$=any beta-2 amino acid; $\alpha_6$=an alpha alanine, $\alpha_7$=an alpha valine, $\alpha_8$=an alpha lysine, $\beta_4$=any beta-2 amino acid; $\alpha_9$=an alpha tyrosine; $\alpha_{10}$=an alpha leucine, $\beta_5$=any beta-2 amino acid; $\alpha_{11}$=an alpha alanine, $\alpha_{12}$=an alpha isoleucine, $\alpha_{13}$=an alpha leucine; and $\beta_6$=any beta-2 amino acid.

In some embodiments, the composition comprises a VIP analog, wherein the analog comprises the following repetitive pattern of sequential β-amino acids from the amino-terminus:

$\beta_1\alpha_1\alpha_2\alpha_3\beta_2\alpha_4\alpha_5\beta_3\alpha_6\alpha_7\alpha_8\beta_4\alpha_9\alpha_{10}\beta_5\alpha_{11}\alpha_{12}\alpha_{13}\beta_6$;

wherein $\beta_1$=any cyclic or heterocyclic beta amino acid; $\alpha_1$=an alpha threonine, $\alpha_2$=an alpha arginine, $\alpha_3$=an alpha leucine, $\beta_2$=any cyclic or heterocyclic beta amino acid; $\alpha_4$=an alpha lysine, $\alpha_5$=an alpha glutamine, $\beta_3$=any cyclic or heterocyclic beta amino acid; $\alpha_6$=an alpha alanine, $\alpha_7$=an alpha valine, $\alpha_8$=an alpha lysine, $\beta_4$=any cyclic or heterocyclic beta amino acid; $\alpha_9$=an alpha tyrosine; $\alpha_{10}$=an alpha leucine, $\beta_5$=any cyclic or heterocyclic beta amino acid; $\alpha_{11}$=an alpha alanine, $\alpha_{12}$=an alpha isoleucine, $\alpha_{13}$=an alpha leucine; and $\beta_6$=any cyclic or heterocyclic beta amino acid.

In some embodiments, the composition comprises a VIP analog, wherein the analog comprises the following repetitive pattern of sequential β-amino acids from the amino-terminus:

$\beta_1\alpha_1\alpha_2\alpha_3\beta_2\alpha_4\alpha_5\beta_3\alpha_6\alpha_7\alpha_8\beta_4\alpha_9\alpha_{10}\beta_5\alpha_{11}\alpha_{12}\alpha_{13}\beta_6$;

wherein $\beta_1$=any beta amino acid; $\alpha_1$=an alpha threonine, $\alpha_2$=an alpha arginine, $\alpha_3$=an alpha leucine, $\beta_2$=a beta-2 arginine or APC; $\alpha_4$=an alpha lysine, $\alpha_5$=an alpha glutamine, $\beta_3$=any beta-2 amino acid; $\alpha_6$=an alpha alanine, $\alpha_7$=an alpha valine, $\alpha_8$=an alpha lysine, $\beta_4$=any beta-2 amino acid; $\alpha_9$=an alpha tyrosine; $\alpha_{10}$=an alpha leucine, $\beta_5$=any beta-2 amino acid; $\alpha_{11}$=an alpha alanine, $\alpha_{12}$=an alpha isoleucine, $\alpha_{13}$=an alpha leucine; and $\beta_6$=any beta-2 amino acid.

In some embodiments, the composition comprises a VIP analog, wherein the analog comprises the following repetitive pattern of sequential β-amino acids from the amino-terminus:

$\beta_1\alpha_1\alpha_2\alpha_3\beta_2\alpha_4\alpha_5\beta_3\alpha_6\alpha_7\alpha_8\beta_4\alpha_9\alpha_{10}\beta_5\alpha_{11}\alpha_{12}\alpha_{13}\beta_6$;

wherein $\beta_1$=a beta-3 tyrosine; $\alpha_1$=an alpha threonine, $\alpha_2$=an alpha arginine, $\alpha_3$=an alpha leucine, $\beta_2$=a beta-3 arginine or APC; $\alpha_4$=an alpha lysine, $\alpha_5$=an alpha glutamine, $\beta_3$=a beta-3 leucine or ACPC; $\alpha_6$=an alpha alanine, $\alpha_7$=an alpha valine, $\alpha_8$=an alpha lysine, $\beta_4$=a beta-3 lysine or APC; $\alpha_9$=an alpha tyrosine; $\alpha_{10}$=an alpha leucine, $\beta_5$=a beta-3 asparagine or ACPC; $\alpha_{11}$=an alpha alanine, $\alpha_{12}$=an alpha isoleucine, $\alpha_{13}$=an alpha leucine; and $\beta_6$=a beta-3 asparagine.

In some embodiments, the composition comprises a VIP analog, wherein the analog comprises the following repetitive pattern of sequential β-amino acids from the amino-terminus selected from the following:
$\beta_1\alpha_1\alpha_2\beta_2\alpha_3\alpha_4\alpha_5\beta_3\alpha_6\alpha_7\beta_4\alpha_8\alpha_9\alpha_{10}\beta_5\alpha_{11}\alpha_{12}\beta_6$, wherein $\beta_1$=any beta amino acid, $\alpha_1$=any alpha amino acid, $\alpha_2$=any alpha amino acid, $\beta_2$=any beta amino acid, $\alpha_3$=any alpha amino acid, $\alpha_4$=any alpha amino acid; $\alpha_5$=any alpha amino acid, $\beta_3$=any beta amino acid, $\alpha_6$=any alpha amino acid; $\alpha_7$=any alpha amino acid; $\beta_4$=any beta amino acid, $\alpha_8$=any alpha amino acid; $\alpha_9$=any alpha amino acid; $\alpha_{10}$=any alpha amino acid; $\beta_5$=any beta amino acid; $\alpha_{11}$=any alpha amino acid, $\alpha_{12}$=any alpha amino acid, $\beta_6$=any beta amino acid; and $\beta_1\alpha_1\alpha_2\beta_2\alpha_3\alpha_4\alpha_5\beta_3\alpha_6\alpha_7\beta_4\alpha_8\alpha_9\alpha_{10}\beta_5\alpha_{11}\alpha_{12}\alpha_{13}\beta_6$; wherein $\beta_1$=any beta amino acid; $\alpha_1$=any alpha amino acid, $\alpha_2$=any alpha amino acid, $\alpha_3$=an alpha amino acid, $\beta_2$=any beta amino acid; $\alpha_4$=an alpha alpha amino acid, $\alpha_5$=any alpha amino acid, $\beta_3$=any beta amino acid; $\alpha_6$=any alpha amino acid, $\alpha_7$=any alpha amino acid, $\alpha_8$=any alpha amino acid, $\beta_4$=any beta amino acid; $\alpha_9$=any alpha amino acid, $\alpha_{10}$=any alpha amino acid, $\beta_5$=any beta amino acid; $\alpha_{11}$=any alpha amino acid, $\alpha_{12}$=any alpha amino acid, $\alpha_{13}$=any alpha amino acid; and $\beta_6$=any beta amino acid; and wherein the repetitive pattern is, optionally, preceded by:
HSDAVFTDNY (SEQ ID NO: 1340) if the composition comprises $\beta_1\alpha_1\alpha_2\beta_2\alpha_3\alpha_4\alpha_5\beta_3\alpha_6\alpha_7\beta_4\alpha_8\alpha_9\alpha_{10}\beta_5\alpha_{11}\alpha_{12}\beta_6$, or HSDAVFTDN (SEQ ID NO: 1341) if the composition comprises $\beta_1\alpha_2\alpha_3\beta_2\alpha_4\alpha_5\beta_3\alpha_6\alpha_7\alpha_8\beta_4\alpha_9\alpha_{10}\beta_5\alpha_{11}\beta_{12}\beta_6$, and
wherein the C-terminus is optionally amidated; and
wherein the N-terminus is optionally acylated;
or functional fragments thereof.

In some embodiments, the composition comprises a VIP analog, wherein the analog comprises the following repetitive pattern of sequential β-amino acids from the amino-terminus selected from the following:
$\beta_1\alpha_1\alpha_2\alpha_3\beta_2\alpha_4\alpha_5\beta_3\alpha_6\alpha_7\alpha_8\beta_4\alpha_9\beta_{10}\beta_5\alpha_{11}\alpha_{12}\alpha_{13}$,
wherein $\beta_1$=any beta amino acid; $\alpha_1$=any alpha amino acid, $\alpha_2$=any alpha amino acid, $\alpha_3$=any alpha amino acid, $\beta_2$=any beta amino acid; $\alpha_4$=any alpha amino acid, $\alpha_5$=any alpha amino acid, $\beta_3$=any beta amino acid; α6=any alpha amino acid, α7=any alpha amino acid, α8=any alpha amino acid, $\beta_4$=any beta amino acid; $\alpha_9$=any alpha amino acid, $\alpha_{10}$=any alpha amino acid, $\beta_5$=any beta amino acid; $\alpha_{11}$=any alpha amino acid, $\alpha_{12}$=any alpha amino acid, $\alpha_{13}$=any alpha amino acid;

$\beta_1\alpha_1\alpha_2\beta_2\alpha_3\alpha_4\alpha_5\beta_3\alpha_6\alpha_7\beta_4\alpha_8\alpha_9\alpha_{10}\beta_5\alpha_{11}\alpha_{12}\beta_6$, wherein $\beta_1$=any beta amino acid, $\alpha_1$=any alpha amino acid, $\alpha_2$=any alpha amino acid, $\beta_2$=any beta amino acid, $\alpha_3$=any alpha amino acid, $\alpha_4$=any alpha amino acid; $\alpha_5$=any alpha amino acid, $\beta_3$=any beta amino acid, $\alpha_6$=any alpha amino acid; $\alpha_7$=any alpha amino acid; $\beta_4$=any beta amino acid, $\alpha_8$=any alpha amino acid; $\alpha_9$=any alpha amino acid; $\alpha_{10}$=any alpha amino acid; $\beta_5$=any beta amino acid; $\alpha_{11}$=any alpha amino acid, $\alpha_{12}$=any alpha amino acid, $\beta_6$=any beta amino acid; and $\beta_1\alpha_1\alpha_2\alpha_3\beta_2\alpha_4\alpha_5\beta_3\alpha_6\alpha_7\alpha_8\beta_4\alpha_9\alpha_{10}\beta_5\alpha_{11}\alpha_{12}\alpha_{13}\beta_6$; wherein $\beta_1$=any beta amino acid; $\alpha_1$=any alpha amino acid, $\alpha_2$=any alpha amino acid, $\alpha_3$=an alpha amino acid, $\beta_2$=any beta amino acid; $\alpha_4$=an alpha alpha amino acid, $\alpha_5$=any alpha amino acid, $\beta_3$=any beta amino acid; $\alpha_6$=any alpha amino acid, $\alpha_7$=any alpha amino acid, $\alpha_8$=any alpha amino acid, $\beta_4$=any beta amino acid; $\alpha_9$=any alpha amino acid, $\alpha_{10}$=any alpha amino acid, $\beta_5$=any beta amino acid; $\alpha_{11}$=any alpha amino acid, $\alpha_{12}$=any alpha amino acid, $\alpha_{13}$=any alpha amino acid; and $\beta_6$=any beta amino acid; and wherein the repetitive pattern is, optionally, preceded by:
HSDAVFTDNY (SEQ ID NO: 1340) if the composition comprises $\beta_1\alpha_1\alpha_2\beta_2\alpha_3\alpha_4\alpha_5\beta_3\alpha_6\alpha_7\alpha_8\beta_4\alpha_9\alpha_{10}\beta_5\alpha_{11}\alpha_{12}\alpha_{13}$ or $\beta_1\alpha_1\alpha_2\beta_2\alpha_3\alpha_4\alpha_5\beta_3\alpha_6\alpha_7\beta_4\alpha_8\alpha_9\alpha_{10}\beta_5\alpha_{11}\alpha_{12}\beta_6$ or HSDAVFTDN (SEQ ID NO: 1341) if the composition comprises $\beta_1\alpha_2\alpha_3\beta_2\alpha_4\alpha_5\beta_3\alpha_6\alpha_7\alpha_8\beta_4\alpha_9\alpha_{10}\beta_5\alpha_{11}\alpha_{12}\alpha_{13}\beta_6$, and
wherein the C-terminus is optionally amidated; and
wherein the N-terminus is optionally acylated;
or functional fragments thereof.

In some embodiments, the composition comprises a VIP analog, wherein the analog comprises the following repetitive pattern of sequential β-amino acids from the amino-terminus selected from the following:
$\beta_1\alpha_1\alpha_2\alpha_3\beta_2\alpha_4\alpha_5\beta_3\alpha_6\alpha_7\alpha_8\beta_4\alpha_9\alpha_{10}\beta_5\alpha_{11}\alpha_{12}\alpha_{13}$,
wherein $\beta_1$=any beta amino acid; $\alpha_1$=any alpha amino acid, $\alpha_2$=any alpha amino acid, $\alpha_3$=any alpha amino acid, $\beta_2$=any beta amino acid; $\alpha_4$=any alpha amino acid, $\alpha_5$=any alpha amino acid, $\beta_3$=any beta amino acid; α6=any alpha amino acid, α7=any alpha amino acid, α8=any alpha amino acid, $\beta_4$=any beta amino acid; $\alpha_9$=any alpha amino acid, $\alpha_{10}$=any alpha amino acid, $\beta_5$=any beta amino acid; $\alpha_{11}$=any alpha amino acid, $\alpha_{12}$=any alpha amino acid, $\alpha_{13}$=any alpha amino acid;

$\beta_1\alpha_1\alpha_2\beta_2\alpha_3\alpha_4\alpha_5\beta_3\alpha_6\alpha_7\beta_4\alpha_8\alpha_9\alpha_{10}\beta_5\alpha_{11}\alpha_{12}\beta_6$, wherein $\beta_1$=any beta amino acid, $\alpha_1$=any alpha amino acid, $\alpha_2$=any alpha amino acid, $\beta_2$=any beta amino acid, $\alpha_3$=any alpha amino acid, $\alpha_4$=any alpha amino acid; $\alpha_5$=an alpha leucine, $\beta_3$=any beta amino acid, $\alpha_6$=any alpha amino acid; $\alpha_7$=any alpha amino acid; $\beta_4$=any beta amino acid, $\alpha_8$=any alpha amino acid; $\alpha_9$=any alpha amino acid; $\alpha_{10}$=any alpha amino acid; $\beta_5$=a beta-3 alanine or an ACPC; $\alpha_{13}$=any alpha amino acid, $\alpha_{12}$=any alpha amino acid, $\beta_6$=any beta amino acid; and $\beta_1\alpha_1\alpha_2\alpha_3\beta_2\alpha_4\alpha_5\beta_3\alpha_6\alpha_7\alpha_8\beta_4\alpha_9\alpha_{10}\beta_5\alpha_{11}\alpha_{12}\alpha_{13}\beta_6$; wherein $\beta_1$=any beta amino acid; $\alpha_1$=any alpha amino acid, $\alpha_2$=any alpha amino acid, $\alpha_3$=an alpha amino acid, $\beta_2$=any beta amino acid; $\alpha_4$=an alpha alpha amino acid, $\alpha_5$=any alpha amino acid, $\beta_3$=any beta amino acid; $\alpha_6$=any alpha amino acid, $\alpha_7$=any alpha amino acid, $\alpha_8$=any alpha amino acid, $\beta_4$=any beta amino acid; $\alpha_9$=any alpha amino acid, $\alpha_{10}$=any alpha amino acid, $\beta_5$=any beta amino acid; $\alpha_{11}$=any alpha amino acid, $\alpha_{12}$=any alpha amino acid, $\alpha_{13}$=any alpha amino acid; and $\beta_6$=any beta amino acid; and wherein the repetitive pattern is, optionally, preceded by:
HSDAVFTDNY (SEQ ID NO: 1340) if the composition comprises $\beta_1\alpha_1\alpha_2\alpha_3\beta_2\alpha_4\alpha_5\beta_3\alpha_6\alpha_7\alpha_8\beta_4\alpha_9\alpha_{10}\beta_5\alpha_{11}\alpha_{12}\alpha_{13}$ or $\beta_1\alpha_1\alpha_2\beta_2\alpha_3\alpha_4\alpha_5\beta_3\alpha_6\alpha_7\beta_4\alpha_8\alpha_9\alpha_{10}\beta_5\beta_{11}\alpha_{12}\beta_6$ or HSDAVFTDN (SEQ ID NO: 1341) if the composition comprises $\beta_1\alpha_2\alpha_3\beta_2\alpha_4\alpha_5\beta_3\alpha_6\alpha_7\alpha_8\beta_4\alpha_9\alpha_{10}\beta_5\beta_{11}\beta_{12}\alpha_{13}\beta_6$, and
wherein the C-terminus is optionally amidated; and
wherein the N-terminus is optionally acylated;
or functional fragments thereof.

In some embodiments, the composition comprises a VIP analog, wherein the analog comprises the following repetitive pattern of sequential β-amino acids from the amino-terminus selected from the following:
$\beta_1\alpha_1\alpha_2\alpha_3\beta_2\alpha_4\alpha_5\beta_3\alpha_6\alpha_7\alpha_8\beta_4\alpha_9\alpha_{10}\beta_5\alpha_{11}\alpha_{12}\alpha_{13}$,
wherein $\beta_1$=any beta amino acid; $\alpha_1$=any alpha amino acid, $\alpha_2$=any alpha amino acid, $\alpha_3$=any alpha amino acid, $\beta_2$=any beta amino acid; $\alpha_4$=any alpha amino acid, $\alpha_5$=any alpha amino acid, $\beta_3$=any beta amino acid; α6=any alpha amino acid, α7=any alpha amino acid, α8=any alpha amino acid, $\beta_4$=any beta amino acid; $\alpha_9$=any alpha amino acid, $\alpha_{10}$=any alpha amino acid, $\beta_5$=any beta amino acid; $\alpha_{11}$=any alpha amino acid, $\alpha_{12}$=any alpha amino acid, $\alpha_{13}$=any alpha amino acid;

$\beta_1\alpha_1\alpha_2\beta_2\alpha_3\alpha_4\alpha_5\beta_3\alpha_6\alpha_7\beta_4\alpha_8\alpha_9\alpha_{10}\beta_5\alpha_{11}\alpha_{12}\beta_6$, wherein $\beta_1$=any beta amino acid, $\alpha_1$=any alpha amino acid, $\alpha_2$=any alpha amino acid, $\beta_2$=any beta amino acid, $\alpha_3$=any alpha amino acid, $\alpha_4$=any alpha amino acid; $\alpha_5$=an alpha leucine, $\beta_3$=any beta amino acid, $\alpha_6$=any alpha amino acid; $\alpha_7$=any alpha amino acid; $\beta_4$=any beta amino acid, $\alpha_8$=any alpha amino acid; $\alpha_9$=any alpha amino acid; $\alpha_{10}$=any alpha amino acid; $\beta_5$=any beta amino acid, $\alpha_{11}$=any alpha amino acid, $\alpha_{12}$=any alpha amino acid, $\beta_6$=any beta amino acid; and $\beta_1\alpha_1\alpha_2\alpha_3\beta_2\alpha_4\alpha_5\beta_3\alpha_6\alpha_7\alpha_8\beta_4\alpha_9\alpha_{10}\beta_5\alpha_{11}\alpha_{12}\alpha_{13}\beta_6$; wherein $\beta_1$=any beta amino acid; $\alpha_1$=any alpha amino acid, $\alpha_2$=any alpha amino acid, $\alpha_3$=an alpha leucine, $\beta_2$=any beta amino acid; $\alpha_4$=an alpha alpha amino acid, $\alpha_5$=any alpha amino acid, $\beta_3$=any beta amino acid; $\alpha_6$=any alpha amino acid, $\alpha_7$=any alpha amino acid, $\alpha_8$=any alpha amino acid, $\beta_4$=any beta amino acid; $\alpha_9$=any alpha amino acid, $\alpha_{10}$=any alpha amino acid, $\beta_5$=any beta amino acid; $\alpha_{11}$=any alpha amino acid, $\alpha_{12}$=any alpha amino acid, $\alpha_{13}$=any alpha amino acid; and $\beta_6$=any beta amino acid;

wherein the repetitive pattern is, optionally, preceded by: HSDAVFTDNY (SEQ ID NO: 1340) if the composition comprises $\beta_1\alpha_1\alpha_2\alpha_3\beta_2\alpha_4\alpha_5\beta_3\alpha_6\alpha_7\alpha_8\beta_4\alpha_9\alpha_{10}\beta_5\alpha_{11}\alpha_{12}\alpha_{13}$ or $\beta_1\alpha_1\alpha_2\beta_2\alpha_3\alpha_4\alpha_5\beta_3\alpha_6\alpha_7\beta_4\alpha_8\alpha_9\alpha_{10}\beta_5\beta_{11}\alpha_{12}\beta_6$ or HSDAVFTDN (SEQ ID NO: 1341) if the composition comprises $\beta_1\alpha_1\alpha_2\alpha_3\beta_2\alpha_4\alpha_5\beta_3\alpha_6\alpha_7\alpha_8\beta_4\alpha_9\alpha_{10}\beta_5\alpha_{11}\alpha_{12}\alpha_{13}\beta_6$; or a fragment thereof; and wherein at least one or more of the amino acids HSDAVFTDNY (SEQ ID NO: 1340) or HSDAVFTDN (SEQ ID NO: 1341) is substituted with a non-natural amino acid.

In some embodiments, the composition comprises a VIP analog, wherein the analog comprises the following repetitive pattern of sequential β-amino acids from the amino-terminus selected from the following:

$\beta_1\alpha_1\alpha_2\alpha_3\beta_2\alpha_4\alpha_5\beta_3\alpha_6\alpha_7\alpha_8\beta_4\alpha_9\alpha_{10}\beta_5\alpha_{11}\alpha_{12}\alpha_{13}$, wherein $\beta_1$=any beta amino acid; $\alpha_1$=any alpha amino acid, $\alpha_2$=any alpha amino acid, $\alpha_3$=any alpha amino acid, $\beta_2$=any beta amino acid; $\alpha_4$=any alpha amino acid, $\alpha_5$=any alpha amino acid, $\beta_3$=any beta amino acid; α6=any alpha amino acid, α7=any alpha amino acid, α8=any alpha amino acid, $\beta_4$=any beta amino acid; $\alpha_9$=any alpha amino acid, $\alpha_{10}$=any alpha amino acid, $\beta_5$=any beta amino acid; $\alpha_{11}$=any alpha amino acid, $\alpha_{12}$=any alpha amino acid, $\alpha_{13}$=any alpha amino acid;

$\beta_1\alpha_1\alpha_2\beta_2\alpha_3\alpha_4\alpha_5\beta_3\alpha_6\alpha_7\beta_4\alpha_8\alpha_9\alpha_{10}\beta_5\alpha_{11}\alpha_{12}\beta_6$, wherein $\alpha_1$=any beta amino acid, $\alpha_1$=any alpha amino acid, $\alpha_2$=any alpha amino acid, $\beta_2$=any beta amino acid, $\alpha_3$=any alpha amino acid, $\alpha_4$=any alpha amino acid; $\alpha_5$=an alpha leucine, $\beta_3$=any beta amino acid, $\alpha_6$=any alpha amino acid; $\alpha_7$=any alpha amino acid; $\beta_4$=any beta amino acid, $\alpha_8$=any alpha amino acid; $\alpha_9$=any alpha amino acid; $\alpha_{10}$=any alpha amino acid; $\beta_5$=a beta-3 alanine or an ACPC; $\alpha_{11}$=any alpha amino acid, $\alpha_{12}$=any alpha amino acid, $\beta_6$=any beta amino acid; and $\beta_1\alpha_1\alpha_2\alpha_3\beta_2\alpha_4\alpha_5\beta_3\alpha_6\alpha_7\alpha_8\beta_4\alpha_9\alpha_{10}\beta_5\alpha_{11}\alpha_{12}\alpha_{13}\beta_6$; wherein $\beta_1$=any beta amino acid; $\alpha_1$=any alpha amino acid, $\alpha_2$=any alpha amino acid, $\alpha_3$=an alpha leucine, $\beta_2$=any beta amino acid; $\alpha_4$=an alpha alpha amino acid, $\alpha_5$=any alpha amino acid, $\beta_3$=any beta amino acid; $\alpha_6$=any alpha amino acid, $\alpha_7$=any alpha amino acid, $\alpha_8$=any alpha amino acid, $\beta_4$=any beta amino acid; $\alpha_9$=any alpha amino acid, $\alpha_{10}$=any alpha amino acid, $\beta_5$=any beta amino acid; $\alpha_{11}$=any alpha amino acid, $\alpha_{12}$=any alpha amino acid, $\alpha_{13}$=any alpha amino acid; and $\beta_6$=any beta amino acid;

wherein the repetitive pattern is, optionally, preceded by: HSDAVFTDNY (SEQ ID NO: 1340) if the composition comprises $\beta_1\alpha_1\alpha_2\alpha_3\beta_2\alpha_4\alpha_5\beta_3\alpha_6\alpha_7\alpha_8\beta_4\alpha_9\alpha_{10}\beta_5\alpha_{11}\alpha_{12}\alpha_{13}$ or $\beta_1\alpha_1\alpha_2\beta_2\alpha_3\alpha_4\alpha_5\beta_3\alpha_6\alpha_7\beta_4\alpha_8\alpha_9\alpha_{10}\beta_5\alpha_{11}\alpha_{12}\beta_6$ or HSDAVFTDN (SEQ ID NO: 1341) if the composition comprises $\beta_1\alpha_1\alpha_2\alpha_3\beta_2\alpha_4\alpha_5\beta_3\alpha_6\alpha_7\alpha_8\beta_4\alpha_9\alpha_{10}\beta_5\alpha_{11}\alpha_{12}\alpha_{13}\beta_6$; or a fragment thereof; and wherein at least one or more of the amino acids HSDAVFTDNY (SEQ ID NO: 1340) or HSDAVFTDN (SEQ ID NO: 1341) is substituted with a non-natural amino acid.

In some embodiments, the composition comprises a VIP analog, wherein the analog comprises the following repetitive pattern of sequential β-amino acids from the amino-terminus selected from the following:

$\beta_1\alpha_1\alpha_2\alpha_3\beta_2\alpha_4\alpha_5\beta_3\alpha_6\alpha_7\alpha_8\beta_4\alpha_9\alpha_{10}\beta_5\alpha_{11}\alpha_{12}\alpha_{13}$, wherein $\beta_1$=any beta amino acid; $\alpha_1$=any alpha amino acid, $\alpha_2$=any alpha amino acid, $\alpha_3$=any alpha amino acid, $\beta_2$=any beta amino acid; $\alpha_4$=any alpha amino acid, $\alpha_5$=any alpha amino acid, $\beta_3$=any beta amino acid; α6=any alpha amino acid, α7=any alpha amino acid, α8=any alpha amino acid, $\beta_4$=any beta amino acid; $\alpha_9$=any alpha amino acid, $\alpha_{10}$=any alpha amino acid, $\beta_5$=any beta amino acid; $\alpha_{11}$=any alpha amino acid, $\alpha_{12}$=any alpha amino acid, $\alpha_{13}$=any alpha amino acid;

$\beta_1\alpha_1\alpha_2\beta_2\alpha_3\alpha_4\alpha_5\beta_3\alpha_6\alpha_7\beta_4\alpha_8\alpha_9\alpha_{10}\beta_5\alpha_{11}\alpha_{12}\beta_6$, wherein $\alpha_1$=any beta amino acid, $\alpha_1$=any alpha amino acid, $\alpha_2$=any alpha amino acid, $\beta_2$=any beta amino acid, $\alpha_3$=any alpha amino acid, $\alpha_4$=any alpha amino acid; $\alpha_5$=an alpha leucine, $\beta_3$=any beta amino acid, $\alpha_6$=any alpha amino acid; $\alpha_7$=any alpha amino acid; $\beta_4$=any beta amino acid, $\alpha_8$=any alpha amino acid; $\alpha_9$=any alpha amino acid; $\alpha_{10}$=any alpha amino acid; $\beta_5$=any beta amino acid, $\alpha_{11}$=any alpha amino acid, $\alpha_{12}$=any alpha amino acid, $\beta_6$=any beta amino acid; and $\beta_1\alpha_1\alpha_2\alpha_3\beta_2\alpha_4\alpha_5\beta_3\alpha_6\alpha_7\alpha_8\beta_4\alpha_9\alpha_{10}\beta_5\alpha_{11}\alpha_{12}\alpha_{13}\beta_6$; wherein $\beta_1$=any beta amino acid; $\alpha_1$=any alpha amino acid, $\alpha_2$=any alpha amino acid, $\alpha_3$=an alpha leucine, $\beta_2$=any beta amino acid; $\alpha_4$=an alpha alpha amino acid, $\alpha_5$=any alpha amino acid, $\beta_3$=any beta amino acid; $\alpha_6$=any alpha amino acid, $\alpha_7$=any alpha amino acid, $\alpha_8$=any alpha amino acid, $\beta_4$=any beta amino acid; $\alpha_9$=any alpha amino acid, $\alpha_{10}$=any alpha amino acid, $\beta_5$=any beta amino acid; $\alpha_{11}$=any alpha amino acid, $\alpha_{12}$=any alpha amino acid, $\alpha_{13}$=any alpha amino acid; and $\beta_6$=any beta amino acid;

wherein the repetitive pattern is, optionally, preceded by: HSDAVFTDNY (SEQ ID NO: 1340) if the composition comprises $\beta_1\alpha_1\alpha_2\alpha_3\beta_2\alpha_4\alpha_5\beta_3\alpha_6\alpha_7\alpha_8\beta_4\alpha_9\alpha_{10}\beta_5\alpha_{11}\alpha_{12}\alpha_{13}$ or $\beta_1\alpha_1\alpha_2\beta_2\alpha_3\alpha_4\alpha_5\beta_3\alpha_6\alpha_7\beta_4\alpha_5\alpha_9\alpha_{10}\beta_5\alpha_{11}\alpha_{12}\beta_6$, or HSDAVFTDN (SEQ ID NO: 1341) if the composition comprises $\beta_1\alpha_1\alpha_2\alpha_3\beta_2\alpha_4\alpha_5\beta_3\alpha_6\alpha_7\alpha_8\beta_4\alpha_9\alpha_{10}\beta_5\alpha_{11}\alpha_{12}\alpha_{13}\beta_6$; and wherein at least one or more of the amino acids HSDAVFTDNY (SEQ ID NO: 1340) or HSDAVFTDN (SEQ ID NO: 1341) is substituted with a beta amino acid selected from the group chosen from: a beta-3 homolog of the wild-type amino acid sequence.

In some embodiments, the composition comprises a VIP analog, wherein the analog comprises the following repetitive pattern of sequential β-amino acids from the amino-terminus selected from the following:

$\beta_1\alpha_1\alpha_2\alpha_3\beta_2\alpha_4\alpha_5\beta_3\alpha_6\alpha_7\alpha_8\beta_4\alpha_9\alpha_{10}\beta_5\alpha_{11}\alpha_{12}\alpha_{13}$, wherein $\beta_1$=any beta amino acid; $\alpha_1$=any alpha amino acid, $\alpha_2$=any alpha amino acid, $\alpha_3$=any alpha amino acid, $\beta_2$=any beta amino acid; $\alpha_4$=any alpha amino acid, $\alpha_5$=any alpha amino acid, $\beta_3$=any beta amino acid; α6=any alpha amino acid, α7=any alpha amino acid, α8=any alpha amino acid, $\beta_4$=any beta amino acid; $\alpha_9$=any alpha amino acid, $\alpha_{10}$=any alpha amino acid, $\beta_5$=any beta amino acid; $\alpha_{11}$=any alpha amino acid, $\alpha_{12}$=any alpha amino acid, $\alpha_{13}$=any alpha amino acid;

$\beta_1\alpha_1\alpha_2\beta_2\alpha_3\alpha_4\alpha_5\beta_3\alpha_6\alpha_7\beta_4\alpha_8\alpha_9\alpha_{10}\beta_5\alpha_{11}\alpha_{12}\beta_6$, wherein $\beta_1$=any beta amino acid, $\alpha_1$=any alpha amino acid, $\alpha_2$=any alpha amino acid, $\beta_2$=any beta amino acid, $\alpha_3$=any alpha amino acid, $\alpha_4$=any alpha amino acid; $\alpha_5$=an alpha leucine, $\beta_3$=any beta amino acid, $\alpha_6$=any alpha amino acid; $\alpha_7$=any alpha amino acid; $\beta_4$=any beta amino acid, $\alpha_8$=any alpha amino acid; $\alpha_9$=any alpha amino acid; $\alpha_{10}$=any alpha amino acid; $\beta_5$=any beta amino acid; $\alpha_{11}$=any alpha amino acid, $\alpha_{12}$=any alpha amino acid, $\beta_6$=any beta amino acid; and $\beta_1\alpha_1\alpha_2\alpha_3\beta_2\alpha_4\alpha_5\beta_3\alpha_6\alpha_7\alpha_8\beta_4\alpha_9\alpha_{10}\beta_5\alpha_{11}\alpha_{12}\alpha_{13}\beta_6$;

wherein $\beta_1$=any beta amino acid; $\alpha_1$=any alpha amino acid, $\alpha_2$=any alpha amino acid, $\alpha_3$=an alpha amino acid, $\beta_2$=any beta amino acid; $\alpha_4$=an alpha alpha amino acid, $\alpha_5$=any alpha amino acid, $\beta_3$=any beta amino acid; $\alpha_6$=any alpha amino acid, $\alpha_7$=any alpha amino acid, $\alpha_8$=any alpha amino acid, $\beta_4$=any beta amino acid; $\alpha_9$=any alpha amino acid, $\alpha_{10}$=any alpha amino acid, $\beta_5$=any beta amino acid; $\alpha_{11}$=any alpha amino acid, $\alpha_{12}$=any alpha amino acid, $\alpha_{13}$=any alpha amino acid; and $\beta_6$=any beta amino acid;

wherein the repetitive pattern is, optionally, preceded by:

HSDAVFTDNY (SEQ ID NO: 1340) if the composition comprises $\beta_1\alpha_1\alpha_2\alpha_3\beta_2\alpha_4\alpha_5\beta_3\alpha_6\alpha_7\alpha_8\beta_4\alpha_9\alpha_{10}\beta_5\alpha_{11}\alpha_{12}\alpha_{13}$ or $\beta_1\alpha_1\alpha_2\beta_2\alpha_3\alpha_4\alpha_5\beta_3\alpha_6\alpha_7\beta_4\alpha_8\alpha_9\alpha_{10}\beta_5\alpha_{11}\alpha_{12}\beta_6$, or HSDAVFTDN (SEQ ID NO: 1341) if the composition comprises $\beta_1\alpha_1\alpha_2\alpha_3\beta_2\alpha_4\alpha_5\beta_3\alpha_6\alpha_7\alpha_8\beta_4\alpha_9\alpha_{10}\beta_5\alpha_{11}\alpha_{12}\alpha_{13}\beta_6$; and wherein at least one or more of the amino acids HSDAVFTDNY (SEQ ID NO: 1340) or HSDAVFTDN (SEQ ID NO: 1341) is substituted with a beta amino acid selected from the group chosen from: APC, ACPC, a beta-2 homolog of a wild-type amino acid, or a beta-3 homolog of a wild-type amino acid.

In some embodiments, the composition comprises a VIP analog, wherein the analog comprises the following repetitive pattern of sequential β-amino acids from the amino-terminus selected from the following:

$\beta_1\alpha_1\alpha_2\alpha_3\beta_2\alpha_4\alpha_5\beta_3\alpha_6\alpha_7\alpha_8\beta_4\alpha_9\alpha_{10}\beta_5\alpha_{11}\alpha_{12}\alpha_{13}$, wherein $\beta_1$=any beta amino acid; $\alpha_1$=any alpha amino acid, $\alpha_2$=any alpha amino acid, $\alpha_3$=any alpha amino acid, $\beta_2$=any beta amino acid; $\alpha_4$=any alpha amino acid, $\alpha_5$=any alpha amino acid, $\beta_3$=any beta amino acid; α6=any alpha amino acid, α7=any alpha amino acid, α8=any alpha amino acid, $\beta_4$=any beta amino acid; $\alpha_9$=any alpha amino acid, $\alpha_{10}$=any alpha amino acid, $\beta_5$=any beta amino acid; $\alpha_{11}$=any alpha amino acid, $\alpha_{12}$=any alpha amino acid, $\alpha_{13}$=any alpha amino acid;

$\beta_1\alpha_1\alpha_2\beta_2\alpha_3\alpha_4\alpha_5\beta_3\alpha_6\alpha_7\beta_4\alpha_8\alpha_9\alpha_{10}\beta_5\alpha_{11}\alpha_{12}\beta_6$, wherein $\beta_1$=any beta amino acid, $\alpha_1$=any alpha amino acid, $\alpha_2$=any alpha amino acid, $\beta_2$=any beta amino acid, $\alpha_3$=any alpha amino acid, $\alpha_4$=any alpha amino acid; $\alpha_5$=any alpha amino acid, $\beta_3$=any beta amino acid, $\alpha_6$=any alpha amino acid; $\alpha_7$=any alpha amino acid; $\beta_4$=any beta amino acid, $\alpha_8$=any alpha amino acid; $\alpha_9$=any alpha amino acid; $\alpha_{10}$=any alpha amino acid; $\beta_5$=any beta amino acid; $\alpha_{11}$=any alpha amino acid, $\alpha_{12}$=any alpha amino acid, $\beta_6$=any beta amino acid; and $\beta_1\alpha_1\alpha_2\alpha_3\beta_2\alpha_4\alpha_5\beta_3\alpha_6\alpha_7\alpha_8\beta_4\alpha_9\alpha_{10}\beta_5\alpha_{11}\alpha_{12}\alpha_{13}\beta_6$;

wherein $\beta_1$=any beta amino acid; $\alpha_1$=any alpha amino acid, $\alpha_2$=any alpha amino acid, $\alpha_3$=an alpha amino acid, $\beta_2$=any beta amino acid; $\alpha_4$=an alpha alpha amino acid, $\alpha_5$=any alpha amino acid, $\beta_3$=any beta amino acid; $\alpha_6$=any alpha amino acid, $\alpha_7$=any alpha amino acid, $\alpha_8$=any alpha amino acid, $\beta_4$=any beta amino acid; $\alpha_9$=any alpha amino acid, $\alpha_{10}$=any alpha amino acid, $\beta_5$=any beta amino acid; $\alpha_{11}$=any alpha amino acid, $\alpha_{12}$=any alpha amino acid, $\alpha_{13}$=any alpha amino acid; and $\beta_6$=any beta amino acid;

wherein the repetitive pattern is, optionally, preceded by:

HSDAVFTDNY (SEQ ID NO: 1340) if the composition comprises $\beta_1\alpha_1\alpha_2\alpha_3\beta_2\alpha_4\alpha_5\beta_3\alpha_6\alpha_7\alpha_8\beta_4\alpha_9\alpha_{10}\beta_5\alpha_{11}\alpha_{12}\alpha_{13}$ or $\beta_1\alpha_1\alpha_2\beta_2\alpha_3\alpha_4\alpha_5\beta_3\alpha_6\alpha_7\beta_4\alpha_8\alpha_9\alpha_{10}\beta_5\alpha_{11}\alpha_{12}\beta_6$, or HSDAVFTDN (SEQ ID NO: 1341) if the composition comprises $\beta_1\alpha_1\alpha_2\alpha_3\beta_2\alpha_4\alpha_5\beta_3\alpha_6\alpha_7\alpha_8\beta_4\alpha_9\alpha_{10}\beta_5\alpha_{11}\alpha_{12}\alpha_{13}\beta_6$; and wherein at least one or more of the amino acids HSDAVFTDNY (SEQ ID NO: 1340) or HSDAVFTDN (SEQ ID NO: 1341) is substituted with a beta amino acid selected from the group chosen from: a beta-3 homolog of the wild-type amino acid sequence, a beta-2 homolog of the wild-type amino acid sequence, ACPC, or APC.

In some embodiments, the composition comprises a VIP analog, wherein the analog comprises the following repetitive pattern of sequential β-amino acids from the amino-terminus selected from the following:

$\beta_1\alpha_1\alpha_2\alpha_3\beta_2\alpha_4\alpha_5\beta_3\alpha_6\alpha_7\alpha_8\beta_4\alpha_9\alpha_{10}\beta_5\alpha_{11}\alpha_{12}\alpha_{13}$, wherein $\beta_1$=any beta amino acid; $\alpha_1$=any alpha amino acid, $\alpha_2$=any alpha amino acid, $\alpha_3$=any alpha amino acid, $\beta_2$=any beta amino acid; $\alpha_4$=any alpha amino acid, $\alpha_5$=any alpha amino acid, $\beta_3$=any beta amino acid; α6=any alpha amino acid, α7=any alpha amino acid, α8=any alpha amino acid, $\beta_4$=any beta amino acid; $\alpha_9$=any alpha amino acid, $\alpha_{10}$=any alpha amino acid, $\beta_5$=any beta amino acid; $\alpha_{11}$=any alpha amino acid, $\alpha_{12}$=any alpha amino acid, $\alpha_{13}$=any alpha amino acid;

$\beta_1\alpha_1\alpha_2\beta_2\alpha_3\alpha_4\alpha_5\beta_3\alpha_6\alpha_7\beta_4\alpha_8\alpha_9\alpha_{10}\beta_5\alpha_{11}\alpha_{12}\beta_6$, wherein $\beta_1$=any beta amino acid, $\alpha_1$=any alpha amino acid, $\alpha_2$=any alpha amino acid, $\beta_2$=any beta amino acid, $\alpha_3$=any alpha amino acid, $\alpha_4$=any alpha amino acid; $\alpha_5$=an alpha amino acid, $\beta_3$=any beta amino acid, $\alpha_6$=any alpha amino acid; $\alpha_7$=any alpha amino acid; $\beta_4$=any beta amino acid, $\alpha_8$=any alpha amino acid; $\alpha_9$=any alpha amino acid; $\alpha_{10}$=any alpha amino acid; $\beta_5$=any beta amino acid; $\alpha_{11}$=any alpha amino acid, $\alpha_{12}$=any alpha amino acid, $\beta_6$=any beta amino acid; and $\beta_1\alpha_1\alpha_2\alpha_3\beta_2\alpha_4\alpha_5\beta_3\alpha_6\alpha_7\alpha_8\beta_4\alpha_9\alpha_{10}\beta_5\alpha_{11}\alpha_{12}\alpha_{13}\beta_6$;

wherein $\beta_1$=any beta amino acid; $\alpha_1$=any alpha amino acid, $\alpha_2$=any alpha amino acid, $\alpha_3$=an alpha amino acid, $\beta_2$=any beta amino acid; $\alpha_4$=an alpha alpha amino acid, $\alpha_5$=any alpha amino acid, $\beta_3$=any beta amino acid; $\alpha_6$=any alpha amino acid, $\alpha_7$=any alpha amino acid, $\alpha_8$=any alpha amino acid, $\beta_4$=any beta amino acid; $\alpha_9$=any alpha amino acid, $\alpha_{10}$=any alpha amino acid, $\beta_5$=any beta amino acid; $\alpha_{11}$=any alpha amino acid, $\alpha_{12}$=any alpha amino acid, $\alpha_{13}$=any alpha amino acid; and $\beta_6$=any beta amino acid;

wherein the repetitive pattern is, optionally, preceded by:

HSDAVFTDNY (SEQ ID NO: 1340) if the composition comprises $\beta_1\alpha_1\alpha_2\alpha_3\beta_2\alpha_4\alpha_5\beta_3\alpha_6\alpha_7\alpha_8\beta_4\alpha_9\alpha_{10}\beta_5\alpha_{11}\alpha_{12}\alpha_{13}$ or $\beta_1\alpha_1\alpha_2\beta_2\alpha_3\alpha_4\alpha_5\beta_3\alpha_6\alpha_7\beta_4\alpha_8\alpha_9\alpha_{10}\beta_5\alpha_{11}\alpha_{12}\beta_6$, or HSDAVFTDN (SEQ ID NO: 1341) if the composition comprises $\beta_1\alpha_1\alpha_2\alpha_3\beta_2\alpha_4\alpha_5\beta_3\alpha_6\alpha_7\alpha_8\beta_4\alpha_9\alpha_{10}\beta_5\alpha_{11}\alpha_{12}\alpha_{13}\beta_6$; and wherein the D at position 8 of HSDAVFTDNY (SEQ ID NO: 1340) is substituted with a beta amino acid selected from the group chosen from: a beta-3 homolog of the wild-type amino acid sequence, a beta-2 homolog of the wild-type amino acid sequence, ACPC, or APC.

In some embodiments, the composition comprises a VIP analog, wherein the analog comprises the following repetitive pattern of sequential β-amino acids from the amino-terminus selected from the following:

$\beta_1\alpha_1\alpha_2\alpha_3\beta_2\alpha_4\alpha_5\beta_3\alpha_6\alpha_7\alpha_8\beta_4\alpha_9\alpha_{10}\beta_5\alpha_{11}\alpha_{12}\alpha_{13}$, wherein $\beta_1$=any beta amino acid; $\alpha_1$=any alpha amino acid, $\alpha_2$=any alpha amino acid, $\alpha_3$=any alpha amino acid, $\beta_2$=any beta amino acid; $\alpha_4$=any alpha amino acid, $\alpha_5$=any alpha amino acid, $\beta_3$=any beta amino acid; α6=any alpha amino acid, $\alpha_7$=any alpha amino acid, $\alpha_8$=any alpha amino acid, $\beta_4$=any beta amino acid; $\alpha_9$=any alpha amino acid, $\alpha_{10}$=any alpha amino acid, $\beta_5$=any beta amino acid; $\alpha_{11}$=any alpha amino acid, $\alpha_{12}$=any alpha amino acid, $\alpha_{13}$=any alpha amino acid;

$\beta_1\alpha_1\alpha_2\beta_2\alpha_3\alpha_4\alpha_5\beta_3\alpha_6\alpha_7\beta_4\alpha_8\alpha_9\alpha_{10}\beta_5\alpha_{11}\alpha_{12}\beta_6$, wherein $\beta_1$=any beta amino acid, $\alpha_1$=any alpha amino acid, $\alpha_2$=any alpha amino acid, $\beta_2$=any beta amino acid, $\alpha_3$=any alpha amino acid, $\alpha_4$=any alpha amino acid; $\alpha_5$=an alpha amino acid, $\beta_3$=any beta amino acid, $\alpha_6$=any alpha amino acid; $\alpha_7$=any alpha amino acid; $\beta_4$=any beta amino acid, $\alpha_8$=any alpha amino acid; $\alpha_9$=any alpha amino acid; $\alpha_{10}$=any alpha amino acid; $\beta_5$=any beta amino acid; $\alpha_{11}$=any alpha amino acid, $\alpha_{12}$=any alpha amino acid, $\beta_6$=any beta amino acid; and $\beta_1\alpha_1\alpha_2\alpha_3\beta_2\alpha_4\alpha_5\beta_3\alpha_6\alpha_7\alpha_8\beta_4\alpha_9\alpha_{10}\beta_5\alpha_{11}\alpha_{12}\alpha_{13}\beta_6$; wherein $\beta_1$=any beta amino acid; $\alpha_1$=any alpha amino acid, $\alpha_2$=any alpha amino acid, $\alpha_3$=an alpha amino acid, $\beta_2$=any beta amino acid; $\alpha_4$=an alpha alpha amino acid, $\alpha_5$=any alpha amino acid, $\beta_3$=any beta amino acid; $\alpha_6$=any alpha amino acid, $\alpha_7$=any alpha amino acid, $\alpha_8$=any alpha amino acid, $\beta_4$=any beta amino acid; $\alpha_9$=any alpha amino acid, $\alpha_{10}$=any alpha amino acid, $\beta_5$=any beta amino acid; $\alpha_{11}$=any alpha amino acid, $\alpha_{12}$=any alpha amino acid, $\alpha_{13}$=any alpha amino acid; and $\beta_6$=any beta amino acid;

wherein the repetitive pattern is, optionally, preceded by: HSDAVFTDNY (SEQ ID NO: 1340) if the composition comprises $\beta_1\alpha_1\alpha_2\alpha_3\beta_2\alpha_4\alpha_5\beta_3\alpha_6\alpha_7\alpha_8\beta_4\alpha_9\alpha_{10}\beta_5\alpha_{11}\alpha_{12}\alpha_{13}$ or $\beta_1\alpha_1\alpha_2\beta_2\alpha_3\alpha_4\alpha_5\beta_3\alpha_6\alpha_7\beta_4\alpha_8\alpha_9\alpha_{10}\beta_5\alpha_{11}\alpha_{12}\beta_6$; or HSDAVFTDN (SEQ ID NO: 1341) if the composition comprises $\beta_1\alpha_1\alpha_2\alpha_3\beta_2\alpha_4\alpha_5\beta_3\alpha_6\alpha_7\alpha_8\beta_4\alpha_9\alpha_{10}\beta_5\alpha_{11}\alpha_{12}\alpha_{13}\beta_6$; and wherein the T at position 7 of HSDAVFTDNY (SEQ ID NO: 1340) is substituted with a beta amino acid selected from the group chosen from: a beta-3 homolog of the wild-type amino acid sequence, a beta-2 homolog of the wild-type amino acid sequence, ACPC, or APC.

In some embodiments, the composition comprises a VIP analog, wherein the analog comprises the following repetitive pattern of sequential β-amino acids from the amino-terminus selected from the following:

$\beta_1\alpha_1\alpha_2\alpha_3\beta_2\alpha_4\alpha_5\beta_3\alpha_6\alpha_7\alpha_8\beta_4\alpha_9\alpha_{10}\beta_5\alpha_{11}\alpha_{12}\alpha_{13}$, wherein $\beta_1$=any beta amino acid; $\alpha_1$=any alpha amino acid, $\alpha_2$=any alpha amino acid, $\alpha_3$=any alpha amino acid, $\beta_2$=any beta amino acid; $\alpha_4$=any alpha amino acid, $\alpha_5$=any alpha amino acid, $\beta_3$=any beta amino acid; $\alpha_6$=any alpha amino acid, $\alpha_7$=any alpha amino acid, $\alpha_8$=any alpha amino acid, $\beta_4$=any beta amino acid; $\alpha_9$=any alpha amino acid, $\alpha_{10}$=any alpha amino acid, $\beta_5$=any beta amino acid; $\alpha_{11}$=any alpha amino acid, $\alpha_{12}$=any alpha amino acid, $\alpha_{13}$=any alpha amino acid;

$\beta_1\alpha_1\alpha_2\beta_2\alpha_3\alpha_4\alpha_5\beta_3\alpha_6\alpha_7\beta_4\alpha_8\alpha_9\alpha_{10}\beta_5\alpha_{11}\alpha_{12}\beta_6$, wherein $\beta_1$=any beta amino acid, $\alpha_1$=any alpha amino acid, $\alpha_2$=any alpha amino acid, $\beta_2$=any beta amino acid, $\alpha_3$=any alpha amino acid, $\alpha_4$=any alpha amino acid; $\alpha_5$=an alpha amino acid, $\beta_3$=any beta amino acid, $\alpha_6$=any alpha amino acid; $\alpha_7$=any alpha amino acid; $\beta_4$=any beta amino acid, $\alpha_8$=any alpha amino acid; $\alpha_9$=any alpha amino acid; $\alpha_{10}$=any alpha amino acid; $\beta_5$=any beta amino acid; $\alpha_{13}$=any alpha amino acid, $\alpha_{12}$=any alpha amino acid, $\beta_6$=any beta amino acid; and $\beta_1\alpha_1\alpha_2\alpha_3\beta_2\alpha_4\alpha_5\beta_3\alpha_6\alpha_7\alpha_8\beta_4\alpha_9\alpha_{10}\beta_5\alpha_{11}\alpha_{12}\alpha_{13}\beta_6$; wherein $\beta_1$=any beta amino acid; $\alpha_1$=any alpha amino acid, $\alpha_2$=any alpha amino acid, $\alpha_3$=an alpha amino acid, $\beta_2$=any beta amino acid; $\alpha_4$=an alpha alpha amino acid, $\alpha_5$=any alpha amino acid, $\beta_3$=any beta amino acid; $\alpha_6$=any alpha amino acid, $\alpha_7$=any alpha amino acid, $\alpha_8$=any alpha amino acid, $\beta_4$=any beta amino acid; $\alpha_9$=any alpha amino acid, $\alpha_{10}$=any alpha amino acid, $\beta_5$=any beta amino acid; $\alpha_{11}$=any alpha amino acid, $\alpha_{12}$=any alpha amino acid, $\alpha_{13}$=any alpha amino acid; and $\beta_6$=any beta amino acid;

wherein the repetitive pattern is, optionally, preceded by: HSDAVFTDNY (SEQ ID NO: 1340) if the composition comprises $\beta_1\alpha_1\alpha_2\alpha_3\beta_2\alpha_4\alpha_5\beta_3\alpha_6\alpha_7\alpha_8\beta_4\alpha_9\alpha_{10}\beta_5\alpha_{11}\alpha_{12}\alpha_{13}$ or $\beta_1\alpha_1\alpha_2\beta_2\alpha_3\alpha_4\alpha_5\beta_3\alpha_6\alpha_7\beta_4\alpha_8\alpha_9\alpha_{10}\beta_5\alpha_{11}\alpha_{12}\beta_6$ or HSDAVFTDN (SEQ ID NO: 1341) if the composition comprises $\beta_1\alpha_1\alpha_2\alpha_3\beta_2\alpha_4\alpha_5\beta_3\alpha_6\alpha_7\alpha_8\beta_4\alpha_9\alpha_{10}\beta_5\alpha_{11}\alpha_{12}\alpha_{13}\beta_6$; and wherein the D at position 8 of HSDAVFTDNY (SEQ ID NO: 1340) and, optionally, the T at position 7 of HSDAVFTDNY (SEQ ID NO: 1340) is substituted with a beta amino acid selected from the group chosen from: a beta-3 homolog of the wild-type amino acid sequence, a beta-2 homolog of the wild-type amino acid sequence, ACPC, or APC.

In some embodiments, the composition comprises a VIP analog, wherein the analog comprises the following repetitive pattern of sequential β-amino acids from the amino-terminus selected from the following:

$\beta_1\alpha_1\alpha_2\alpha_3\beta_2\alpha_4\alpha_5\beta_3\alpha_6\alpha_7\alpha_8\beta_4\alpha_9\alpha_{10}\beta_5\alpha_{11}\alpha_{12}\alpha_{13}$, wherein $\beta_1$=any beta amino acid; $\alpha_1$=any alpha amino acid, $\alpha_2$=any alpha amino acid, $\alpha_3$=any alpha amino acid, $\beta_2$=any beta amino acid; $\alpha_4$=any alpha amino acid, $\alpha_5$=any alpha amino acid, $\beta_3$=any beta amino acid; α6=any alpha amino acid, α7=any alpha amino acid, α8=any alpha amino acid, $\beta_4$=any beta amino acid; $\alpha_9$=any alpha amino acid, $\alpha_{10}$=any alpha amino acid, $\beta_5$=any beta amino acid; $\alpha_2$=any alpha amino acid, $\alpha_{12}$=any alpha amino acid, $\alpha_{13}$=any alpha amino acid;

$\beta_1\alpha_1\alpha_2\beta_2\alpha_3\alpha_4\alpha_5\beta_3\alpha_6\alpha_7\beta_4\alpha_8\alpha_9\alpha_{10}\beta_5\alpha_{11}\alpha_{12}\beta_6$, wherein $\beta_1$=any beta amino acid, $\alpha_1$=any alpha amino acid, $\alpha_2$=any alpha amino acid, $\beta_2$=any beta amino acid, $\alpha_3$=any alpha amino acid, $\alpha_4$=any alpha amino acid; $\alpha_5$=an alpha amino acid, $\beta_3$=any beta amino acid, $\alpha_6$=any alpha amino acid; $\alpha_7$=any alpha amino acid; $\beta_4$=any beta amino acid, $\alpha_8$=any alpha amino acid; $\alpha_9$=any alpha amino acid; $\alpha_{10}$=any alpha amino acid; $\beta_5$=any beta amino acid; $\alpha_{11}$=any alpha amino acid, $\alpha_{12}$=any alpha amino acid, $\beta_6$=any beta amino acid; and $\beta_1\alpha_1\alpha_2\alpha_3\beta_2\alpha_4\alpha_5\beta_3\alpha_6\alpha_7\alpha_8\beta_4\alpha_9\alpha_{10}\beta_5\alpha_{11}\alpha_{12}\alpha_{13}\beta_6$; wherein $\beta_1$=any beta amino acid; $\alpha_1$=any alpha amino acid, $\alpha_2$=any alpha amino acid, $\alpha_3$=an alpha amino acid, $\beta_2$=any beta amino acid; $\alpha_4$=an alpha alpha amino acid, $\alpha_5$=any alpha amino acid, $\beta_3$=any beta amino acid; $\alpha_6$=any alpha amino acid, $\alpha_7$=any alpha amino acid, $\alpha_8$=any alpha amino acid, $\beta_4$=any beta amino acid; $\alpha_9$=any alpha amino acid, $\alpha_{10}$=any alpha amino acid, $\beta_5$=any beta amino acid; $\alpha_{11}$=any alpha amino acid, $\alpha_{12}$=any alpha amino acid, $\alpha_{13}$=any alpha amino acid; and $\beta_6$=any beta amino acid;

wherein the repetitive pattern is, optionally, preceded by: HSDAVFTDNY (SEQ ID NO: 1340) if the composition comprises $\beta_1\alpha_1\alpha_2\alpha_3\beta_2\alpha_4\alpha_5\beta_3\alpha_6\alpha_7\alpha_8\beta_4\alpha_9\alpha_{10}\beta_5\alpha_{11}\alpha_{12}\alpha_{13}$ or $\beta_1\alpha_1\alpha_2\beta_2\alpha_3\alpha_4\alpha_5\beta_3\alpha_6\alpha_7\beta_4\alpha_8\alpha_9\alpha_{10}\beta_5\alpha_{11}\alpha_{12}\beta_6$ or HSDAVFTDN (SEQ ID NO: 1341) if the composition comprises $\beta_1\alpha_1\alpha_2\alpha_3\beta_2\alpha_4\alpha_5\beta_3\alpha_6\alpha_7\alpha_8\beta_4\alpha_9\alpha_{10}\beta_5\alpha_{11}\alpha_{12}\alpha_{13}\beta_6$; and wherein the T at position 7 of HSDAVFTDNY (SEQ ID NO: 1340) and, optionally, the D at position 8 of HSDAVFTDNY (SEQ ID NO: 1340) is substituted with a beta amino acid selected from the group chosen from: a beta-3 homolog of the wild-type amino acid sequence, a beta-2 homolog of the wild-type amino acid sequence ACPC, or APC.

In some embodiments, the composition comprises a VIP analog, wherein the analog comprises the following repetitive pattern of sequential β-amino acids from the amino-terminus to the carboxy-terminus: βααβαααβααβαααβααβ. In some embodiments, the composition comprises a VIP analog, wherein the analog comprises the following repetitive pattern of sequential β-amino acids from the amino-terminus: $\beta_1\alpha_1\alpha_2\beta_2\alpha_3\alpha_4\alpha_5\beta_3\alpha_6\alpha_7\beta_4\alpha_8\alpha_9\alpha_{10}\beta_5\alpha_{11}\alpha_{12}\beta_6$, wherein $\beta_1$=any beta amino acid, $\alpha_1$=any alpha amino acid, $\alpha_2$=any alpha amino acid, $\beta_2$=any beta amino acid, $\alpha_3$=any alpha amino acid, $\alpha_4$=any alpha amino acid; $\alpha_5$=any alpha amino acid, $\beta_3$=any beta amino acid, $\alpha_6$=any alpha amino acid; $\alpha_7$=any alpha amino acid; $\beta_4$=any beta amino acid, $\alpha_8$=any alpha amino acid; $\alpha_9$=any alpha amino acid; $\alpha_{10}$=any alpha amino acid; $\beta_5$=any beta amino acid; $\alpha_{13}$=any alpha amino acid, $\alpha_{12}$=any alpha amino acid, $\beta_6$=any beta amino acid; wherein the repetitive pattern is, optionally, preceded by: HSDAVFTDNY (SEQ ID NO: 1340) if the composition comprises, and
    wherein the C-terminus is, optionally, amidated; and
    wherein the N-terminus is, optionally, acylated;
    or functional fragments thereof.

In some embodiments, the composition comprises a VIP analog, wherein the analog comprises the following repetitive pattern of sequential β-amino acids from the amino-terminus: $\beta_1\alpha_1\alpha_2\beta_2\alpha_3\alpha_4\alpha_5\beta_3\alpha_6\alpha_7\beta_4\alpha_8\alpha_9\alpha_{10}\beta_5\alpha_{11}\alpha_{12}\beta_6$, wherein $\beta_1$=a beta 3-threonine, $\alpha_1$=any alpha amino acid; $\alpha_2$=any alpha amino acid; $\beta_2$=a beta-3 arginine; $\alpha_3$=any alpha amino acid; $\alpha_4$=any alpha amino acid; $\alpha_5$=any alpha amino acid; $\beta_3$=a beta-3 alanine; $\alpha_6$=any alpha amino acid; $\alpha_7$=any alpha amino acid; $\beta_4$=a beta-3 lysine, $\alpha_8$=any alpha amino acid; $\alpha_9$=any alpha amino acid; $\alpha_{10}$=any alpha amino acid; $\beta_5$=a beta-3 asparagine; $\alpha_{11}$=any alpha amino acid, $\alpha_{12}$=any alpha amino acid, $\beta_6$=any beta amino acid; wherein the repetitive pattern is, optionally, preceded by: HSDAVFTDNY (SEQ ID NO: 1340) if the composition comprises, and
    wherein the C-terminus is, optionally, amidated; and
    wherein the N-terminus is, optionally, acylated;
    or functional fragments thereof.

In some embodiments, the composition comprises a VIP analog, wherein the analog comprises the following repetitive pattern of sequential β-amino acids from the amino-terminus: $\beta_1\alpha_1\alpha_2\beta_2\alpha_3\alpha_4\alpha_5\beta_3\alpha_6\alpha_7\beta_4\alpha_8\alpha_9\alpha_{10}\beta_5\alpha_{11}\alpha_{12}\beta_6$, wherein $\beta_1$=a beta 3-threonine, $\alpha_1$=any alpha amino acid, $\alpha_2$=any alpha amino acid, $\beta_2$=a beta-3 arginine, $\alpha_3$=any alpha amino acid, $\alpha_4$=any alpha amino acid; $\alpha_5$=any alpha amino acid, $\beta_3$=a beta-3 alanine, $\alpha_6$=any alpha amino acid; $\alpha_7$=any alpha amino acid; $\beta_4$=a beta-3 lysine, $\alpha_8$=any alpha amino acid; $\alpha_9$=any alpha amino acid; $\alpha_{10}$=any alpha amino acid; $\beta_5$=a beta-3 alanine; $\alpha_{11}$=any alpha amino acid, $\alpha_{12}$=any alpha amino acid, $\beta_6$=a beta-3 asparagine; wherein the repetitive pattern is, optionally, preceded by: HSDAVFTDNY (SEQ ID NO: 1340) if the composition comprises, and
    wherein the C-terminus is, optionally, amidated; and
    wherein the N-terminus is, optionally, acylated;
    or functional fragments thereof.

In some embodiments, the composition comprises a VIP analog, wherein the analog comprises the following repetitive pattern of sequential β-amino acids from the amino-terminus: $\beta_1\alpha_1\alpha_2\beta_2\alpha_3\alpha_4\alpha_5\beta_3\alpha_6\alpha_7\beta_4\alpha_8\alpha_9\alpha_{10}\beta_5\alpha_{11}\alpha_{12}\beta_6$, wherein $\beta_1$=a beta 3-threonine, $\alpha_1$=any alpha amino acid, $\alpha_2$=any alpha amino acid, $\beta_2$=a beta-3 arginine, $\alpha_3$=any alpha amino acid, $\alpha_4$=any alpha amino acid; $\alpha_5$=an alpha leucine, $\beta_3$=a beta-3 alanine, $\alpha_6$=any alpha amino acid; $\alpha_7$=any alpha amino acid; $\beta_4$=a beta-3 lysine, $\alpha_8$=any alpha amino acid; $\alpha_9$=any alpha amino acid; $\alpha_{10}$=any alpha amino acid; $\beta_5$=a beta-3 alanine; $\alpha_{11}$=any alpha amino acid, $\alpha_{12}$=any alpha amino acid, $\beta_6$=a beta-3 asparagine; wherein the repetitive pattern is, optionally, preceded by: HSDAVFTDNY (SEQ ID NO: 1340) if the composition comprises, and
    wherein the C-terminus is, optionally, amidated; and
    wherein the N-terminus is, optionally, acylated;
    or functional fragments thereof.

In some embodiments, the composition comprises a VIP analog, wherein the analog comprises the following repetitive pattern of sequential β-amino acids from the amino-terminus: $\beta_1\alpha_1\alpha_2\beta_2\alpha_3\alpha_4\alpha_5\beta_3\alpha_6\alpha_7\beta_4\alpha_8\alpha_9\alpha_{10}\beta_5\alpha_{11}\alpha_{12}\beta_6$, wherein $\beta_1$=any beta amino acid, $\alpha_1$=any alpha amino acid, $\alpha_2$=any alpha amino acid, $\beta_2$=any beta amino acid, $\alpha_3$=any alpha amino acid, $\alpha_4$=any alpha amino acid; $\alpha_5$=any alpha amino acid, $\beta_3$=any beta amino acid, $\alpha_6$=any alpha amino acid; $\alpha_7$=any alpha amino acid; $\beta_4$=any beta amino acid, $\alpha_8$=any alpha amino acid; $\alpha_9$=any alpha amino acid; $\alpha_{10}$=any alpha amino acid; $\beta_5$=a beta-3 alanine; $\alpha_{11}$=any alpha amino acid, $\alpha_{12}$=any alpha amino acid, $\beta_6$=a beta-3 asparagine; wherein the repetitive pattern is, optionally, preceded by: HSDAVFTDNY (SEQ ID NO: 1340) if the composition comprises, and
    wherein the C-terminus is, optionally, amidated; and
    wherein the N-terminus is, optionally, acylated;
    or functional fragments thereof.

In some embodiments, the composition comprises a VIP analog, wherein the analog comprises the following repetitive pattern of sequential β-amino acids from the amino-terminus: $\beta_1\alpha_1\alpha_2\beta_2\alpha_3\alpha_4\alpha_5\beta_3\alpha_6\alpha_7\beta_4\alpha_8\alpha_9\alpha_{10}\beta_5\alpha_{11}\alpha_{12}\alpha_6$, wherein $\beta_1$=any beta amino acid, $\alpha_1$=an alpha arginine, $\alpha_2$=an alpha leucine, $\beta_2$=any beta amino acid, $\alpha_3$=an alpha lysine, $\alpha_4$=an alpha glutamine; $\alpha_5$=an alpha leucine, $\beta_3$=any beta amino acid, $\alpha_6$=an alpha valine; $\alpha_7$=an alpha lysine; $\beta_4$=any beta amino acid, $\alpha_8$=an alpha tyrosine; $\alpha_9$=an alpha leucine; $\alpha_{10}$=an alpha asparagine; $\beta_5$=any beta amino acid; $\alpha_{11}$=an alpha isoleucine, $\alpha_{12}$=an alpha leucine, $\beta_6$=any beta amino acid; wherein the repetitive pattern is, optionally, preceded by: HSDAVFTDNY (SEQ ID NO: 1340) if the composition comprises, and
    wherein the C-terminus is, optionally, amidated; and
    wherein the N-terminus is, optionally, acylated;
    or functional fragments thereof.

In some embodiments, the composition comprises a VIP analog, wherein the analog comprises the following repetitive pattern of sequential β-amino acids from the amino-terminus: $\beta_1\alpha_1\alpha_2\beta_2\alpha_3\alpha_4\alpha_5\beta_3\alpha_6\alpha_7\beta_4\alpha_8\alpha_9\alpha_{10}\beta_5\alpha_{11}\alpha_{12}\beta_6$, wherein $\beta_1$=a beta-3 threonine or ACPC; $\alpha_1$=an alpha arginine, $\alpha_2$=an alpha leucine, $\beta_2$=a beta-3 arginine or APC, $\alpha_3$=an alpha lysine, $\alpha_4$=an alpha glutamine; $\alpha_5$=an alpha leucine, $\beta_3$=a beta-3 alanine or ACPC, $\alpha_6$=an alpha valine; $\alpha_7$=an alpha lysine; $\beta_4$=a beta-3 lysine or APC, $\alpha_8$=an alpha tyrosine; $\alpha_9$=an alpha leucine; $\alpha_{10}$=an alpha asparagine; $\beta_5$=a beta-3 alanine or ACPC; $\alpha_{11}$=an alpha isoleucine, $\alpha_{12}$=an alpha leucine, $\beta_6$=a beta-3 asparagine; wherein the repetitive pattern is, optionally, preceded by: HSDAVFTDNY (SEQ ID NO: 1340) if the composition comprises, and
    wherein the C-terminus is, optionally, amidated; and
    wherein the N-terminus is, optionally, acylated;
    or functional fragments thereof.

In some embodiments, the composition comprises a VIP analog, wherein the analog comprises the following repetitive pattern of sequential β-amino acids from the amino-terminus: $\beta_1\alpha_1\alpha_2\beta_2\alpha_3\alpha_4\alpha_5\beta_3\alpha_6\alpha_7\alpha_8\beta_4\alpha_9\alpha_{10}\beta_5\alpha_{11}\alpha_{12}\alpha_{13}$, wherein $\beta_1$=any beta amino acid; $\alpha_1$=any alpha amino acid, $\alpha_2$=any alpha amino acid, $\alpha_3$=any alpha amino acid, $\beta_2$=any beta amino acid; α$_4$=any alpha amino acid, α$_5$=any alpha amino acid, β$_3$=any beta amino acid; α6=any alpha amino acid, α7=any alpha amino acid, α8=any alpha amino acid, β$_4$=any beta amino acid; α$_9$=any alpha amino acid, α$_{10}$=any alpha amino acid, β$_5$=any beta amino acid; α$_{11}$=any alpha amino acid, α$_{12}$=any alpha amino acid, α$_{13}$=any alpha amino acid; wherein the repetitive pattern is, optionally, preceded by: HSDAVFTDNY (SEQ ID NO: 1340) if the composition comprises, and wherein the C-terminus is, optionally, amidated; and
  wherein the N-terminus is, optionally, acylated;
  or functional fragments thereof.

In some embodiments, the composition comprises a VIP analog, wherein the analog comprises the following repetitive pattern of sequential β-amino acids from the amino-terminus: β$_1$α$_1$α$_2$α$_3$β$_2$α$_4$α$_5$β$_3$α$_6$α$_7$α$_8$β$_4$α$_9$α$_{10}$β$_5$α$_{11}$α$_{12}$α$_{13}$, wherein β$_1$=a beta-3 threonine; α$_1$=any alpha amino acid, α$_2$=any alpha amino acid, α$_3$=any alpha amino acid, β$_2$=a beta-3 lysine; α$_4$=any alpha amino acid, α$_5$=any alpha amino acid, β$_3$=a beta-3 alanine; α6=any alpha amino acid, α7=any alpha amino acid, α8=any alpha amino acid, β$_4$=a beta-3 tyrosine; α$_9$=any alpha amino acid, α$_{10}$=any alpha amino acid, β$_5$=a beta-3 alanine; α$_{11}$=any alpha amino acid, α$_{12}$=any alpha amino acid, α$_{13}$=any alpha amino acid; wherein the repetitive pattern is, optionally, preceded by: HSDAVFTDNY (SEQ ID NO: 1340) if the composition comprises, and wherein the C-terminus is, optionally, amidated; and
  wherein the N-terminus is, optionally, acylated;
  or functional fragments thereof.

In some embodiments, the composition comprises a VIP analog, wherein the analog comprises the following repetitive pattern of sequential β-amino acids from the amino-terminus: β$_1$α$_1$α$_2$α$_3$β$_2$α$_4$α$_5$β$_3$α$_6$α$_7$α$_8$β$_4$α$_9$α$_{10}$β$_5$α$_{11}$α$_{12}$α$_{13}$; wherein β$_1$=any beta amino acid; α$_1$=an alpha arginine, α$_2$=an alpha leucine, α$_3$=an alpha arginine, β$_2$=any beta amino acid; α$_4$=an alpha glutamine, α$_5$=an alpha leucine, β$_3$=any beta amino acid; α$_6$=an alpha valine acid, α$_7$=an alpha lysine, α$_8$=an alpha lysine, β$_4$=any beta amino acid; α$_9$=an alpha leucine, α$_{10}$=an alpha asparagine, β$_5$=any beta amino acid; α$_{11}$=an alpha isoleucine, α$_{12}$=an alpha leucine, α$_{13}$=an alpha asparagine; wherein the repetitive pattern is, optionally, preceded by: HSDAVFTDNY (SEQ ID NO: 1340) if the composition comprises, and wherein the C-terminus is, optionally, amidated; and
  wherein the N-terminus is, optionally, acylated;
  or functional fragments thereof.

In some embodiments, the composition comprises a VIP analog, wherein the analog comprises the following repetitive pattern of sequential β-amino acids from the amino-terminus: β$_1$α$_1$α$_2$α$_3$β$_2$α$_4$α$_5$β$_3$α$_6$α$_7$α$_8$β$_4$α$_9$α$_{10}$β$_5$α$_{11}$α$_{12}$α$_{13}$, wherein β$_1$=a beta-3 threonine or an ACPC; α$_1$=an alpha arginine, α$_2$=an alpha leucine, α$_3$=an alpha arginine, β$_2$=a beta-3 lysine or APC; α$_4$=an alpha glutamine, α$_5$=an alpha leucine, β$_3$=a beta-3 alanine or ACPC; α$_6$=an alpha valine acid, α$_7$=an alpha lysine, α$_8$=an alpha lysine, β$_4$=a beta-3 tyrosine or; α$_9$=an alpha leucine, α$_{10}$=an alpha asparagine, β$_5$=a beta-3 alanine or ACPC; α$_{11}$=an alpha isoleucine, α$_{12}$=an alpha leucine, α$_{13}$=an alpha asparagine; wherein the repetitive pattern is, optionally, preceded by: HSDAVFTDNY (SEQ ID NO: 1340) if the composition comprises, and wherein the C-terminus is, optionally, amidated; and
  wherein the N-terminus is, optionally, acylated;
  or functional fragments thereof.

In some embodiments, the composition comprises a VIP analog, wherein the analog comprises the following repetitive pattern of sequential β-amino acids from the amino-terminus:
β$_1$α$_1$α$_2$α$_3$β$_2$α$_4$α$_5$β$_3$α$_6$α$_7$α$_8$β$_4$α$_9$α$_{10}$β$_5$α$_{11}$α$_{12}$α$_{13}$β$_6$;
wherein β$_1$=any beta amino acid; α$_1$=any alpha amino acid, α$_2$=any alpha amino acid, α$_3$=an alpha amino acid, β$_2$=any beta amino acid; α$_4$=an alpha alpha amino acid, α$_5$=any alpha amino acid, β$_3$=any beta amino acid; α$_6$=any alpha amino acid, α$_7$=any alpha amino acid, α$_8$=any alpha amino acid, β$_4$=any beta amino acid; α$_9$=any alpha amino acid, α$_{10}$=any alpha amino acid, β$_5$=any beta amino acid; α$_{11}$=any alpha amino acid, α$_{12}$=any alpha amino acid, α$_{13}$=any alpha amino acid; and β$_6$=any beta amino acid; wherein the repetitive pattern is, optionally, preceded by: HSDAVFTDN (SEQ ID NO: 1341), and wherein the C-terminus is, optionally, amidated; and
  wherein the N-terminus is, optionally, acylated;
  or functional fragments thereof.

In some embodiments, the composition comprises a VIP analog, wherein the analog comprises the following repetitive pattern of sequential β-amino acids from the amino-terminus:
β$_1$α$_1$α$_2$α$_3$β$_2$α$_4$α$_5$β$_3$α$_6$α$_7$α$_8$β$_4$α$_9$α$_{10}$β$_5$α$_{11}$α$_{12}$α$_{13}$β$_6$;
wherein β$_1$=a beta-3 tyrosine; α$_1$=any alpha amino acid, α$_2$=any alpha amino acid, α$_3$=an alpha amino acid, β$_2$=a beta-3 arginine; α$_4$=an alpha alpha amino acid, α$_5$=any alpha amino acid, β$_3$=a beta-3 leucine; α$_6$=any alpha amino acid, α$_7$=any alpha amino acid, α$_8$=any alpha amino acid, β$_4$=a beta-3 lysine; α$_9$=any alpha amino acid, α$_{10}$=any alpha amino acid, β$_5$=a beta-3 asparagine; α$_{11}$=any alpha amino acid, α$_{12}$=any alpha amino acid, α$_{13}$=any alpha amino acid; and β$_6$=a beta-3 asparagine; wherein the repetitive pattern is, optionally, preceded by: HSDAVFTDN (SEQ ID NO: 1341), and wherein the C-terminus is, optionally, amidated; and
  wherein the N-terminus is, optionally, acylated;
  or functional fragments thereof.

In some embodiments, the composition comprises a VIP analog, wherein the analog comprises the following repetitive pattern of sequential β-amino acids from the amino-terminus:
β$_1$α$_1$α$_2$α$_3$β$_2$α$_4$α$_5$β$_3$α$_6$α$_7$α$_8$β$_4$α$_9$α$_{10}$β$_5$α$_{11}$α$_{12}$α$_{13}$β$_6$;
wherein β$_1$=a beta-3 tyrosine; α$_1$=an alpha threonine, α$_2$=an alpha arginine, α$_3$=an alpha leucine, β$_2$=a beta-3 arginine or APC; α$_4$=an alpha lysine, α$_5$=an alpha glutamine, β$_3$=a beta-3 leucine or ACPC; α$_6$=an alpha alanine, α$_7$=an alpha valine, α$_8$=an alpha lysine, β$_4$=a beta-3 lysine or APC; α$_9$=an alpha tyrosine; α$_{10}$=an alpha leucine, β$_5$=a beta-3 asparagine or ACPC; α$_{11}$=an alpha alanine, α$_{12}$=an alpha isoleucine, α$_{13}$=an alpha leucine; and β$_6$=a beta-3 asparagine; wherein the repetitive pattern is, optionally, preceded by: HSDAVFTDN (SEQ ID NO: 1341), and wherein the C-terminus is, optionally, amidated; and
  wherein the N-terminus is, optionally, acylated;
  or functional fragments thereof.

In some embodiments, the composition comprises a VIP analog, wherein the analog comprises the following repetitive pattern of sequential β-amino acids from the amino-terminus:
β$_1$α$_1$α$_2$α$_3$β$_2$α$_4$α$_5$β$_3$α$_6$α$_7$α$_8$β$_4$α$_9$α$_{10}$β$_5$α$_{11}$α$_{12}$α$_{13}$β$_6$;
wherein β$_1$=a beta-3 tyrosine; α$_1$=an alpha threonine, α$_2$=an alpha arginine, α$_3$=an alpha leucine, β$_2$=a beta-3 arginine or APC; α$_4$=an alpha lysine, α$_5$=an alpha glutamine, β$_3$=a beta-3 leucine or ACPC; α$_6$=an alpha alanine, α$_7$=an alpha valine, α$_8$=an alpha lysine, β$_4$=a beta-3 lysine or APC; α$_9$=an alpha tyrosine; α$_{10}$=an alpha leucine, β$_5$=a beta-3 asparagine or ACPC; α$_{13}$=an alpha alanine, α$_{12}$=an alpha isoleucine, α$_{13}$=an alpha leucine; and β$_6$=a beta-3 asparagine; wherein the repetitive pattern is, optionally, preceded by: HSDAVFTDN (SEQ ID NO: 1341) and
wherein the C-terminus is, optionally, amidated; and
wherein the N-terminus is, optionally, acylated;
or functional fragments thereof.

In some embodiments, the composition comprises HSDAVFTDN (SEQ ID NO: 1341) or HSDAVFTDNY (SEQ ID NO: 1340), wherein at least one of the amino acids from HSDAVFTDN (SEQ ID NO: 1341) or HSDAVFTDNY (SEQ ID NO: 1340) are non-natural or beta amino acids. In some embodiments, the composition comprises HSDAVFTDN (SEQ ID NO: 1341) or HSDAVFTDNY (SEQ ID NO: 1340), wherein at least one of the amino acids from HSDAVFTDN (SEQ ID NO: 1341) or HSDAVFTDNY (SEQ ID NO: 1340) is a beta-3, beta-2, cyclic, or heterocyclic beta amino acids. In some embodiments, the C-terminus is not amidated. In some embodiments, the N-terminus is not acylated. In some embodiments, the composition comprises HSDAVFTDN (SEQ ID NO: 1341) or HSDAVFTDNY (SEQ ID NO: 1340), wherein the amino acids from HSDAVFTDN or HSDAVFTDNY (SEQ ID NO: 1340) are alpha amino acids. In some embodiments, the composition comprises HSDAVFTDN (SEQ ID NO: 1341) or HSDAVFTDNY (SEQ ID NO: 1340), wherein the amino acids from HSDAVFTDN (SEQ ID NO: 1341) or HSDAVFTDNY (SEQ ID NO: 1340) are not alpha amino acids. In some embodiments, the composition comprises HSDAVFTDN (SEQ ID NO: 1341) or HSDAVFTDNY (SEQ ID NO: 1340), wherein none of the amino acids from HSDAVFTDN (SEQ ID NO: 1341) or HSDAVFTDNY (SEQ ID NO: 1340) are beta-3 amino acids. In some embodiments, the composition comprises HSDAVFTDN (SEQ ID NO: 1341) or HSDAVFTDNY (SEQ ID NO: 1340), wherein none of the amino acids from HSDAVFTDN or HSDAVFTDNY (SEQ ID NO: 1340) are beta-2 amino acids. In some embodiments, the composition comprises HSDAVFTDN (SEQ ID NO: 1341) or HSDAVFTDNY (SEQ ID NO: 1340), wherein none of the amino acids from HSDAVFTDN (SEQ ID NO: 1341) or HSDAVFTDNY (SEQ ID NO: 1340) are ACPC or APC. In some embodiments, the composition comprises HSDAVFTDN (SEQ ID NO: 1341) or HSDAVFTDNY (SEQ ID NO: 1340), wherein none of the amino acids from HSDAVFTDN (SEQ ID NO: 1341) or HSDAVFTDNY (SEQ ID NO: 1340) are cyclic. In some embodiments, the composition comprises HSDAVFTDN (SEQ ID NO: 1341) or HSDAVFTDNY (SEQ ID NO: 1340), wherein none of the amino acids from HSDAVFTDN (SEQ ID NO: 1341) or HSDAVFTDNY (SEQ ID NO: 1340) are heterocyclic.

"Selective" or "Selectivity" means that the analog of the present invention has a binding preference for one protein as compared to another protein. In some embodiments, the binding preference may be measured as an affinity for a protein in terms of half maximal inhibitory concentration (IC50). In some embodiments, the binding preference may be measured as an affinity for a protein in terms of half maximal effective concentration (EC50). For example, an analog selective to VPAC2 receptor with a selectivity to VPAC2 means that the analog may bind to VPAC1 receptor but has a higher binding affinity for a domain of the VPAC2 receptor if the analog is exposed to both VPAC1 and VPAC2 at similar or equivalent concentrations. As used herein, an analog that selectively binds to VPAC2 refers to an analog with increased selectivity for the VPAC2 receptor compared to other known receptors or proteins to which the peptide may bind. In some embodiments, the analog selective for VPAC2 may be an agonist of the VPAC2 receptor peptide.

In some embodiments, the analog selective for VPAC2 may be an antagonist of VPAC2 receptor. In some embodiments, an analog selective to VPAC2 receptor means that the analog may bind to VPAC1 receptor but has a higher binding affinity for a domain of the VPAC2 receptor if the analog is exposed to PAC1, VPAC1 receptor and VPAC2 receptors at similar or equivalent concentrations. In some embodiments, an analog selective to VPAC1 receptor means that the analog may bind to a domain of VPAC2 or PAC1 receptor but has a higher binding affinity for a domain of the VPAC1 receptor if the analog is exposed to PAC1, VPAC1 receptor and VPAC2 receptors at similar or equivalent concentrations. As used herein, an analog that selectively binds to VPAC1 refers to an analog with increased selectivity for the VPAC1 receptor compared to other known receptors or proteins to which the peptide may bind. In some embodiments, the analog selective for VPAC1 may be an agonist of the VPAC1 receptor peptide. In some embodiments, the analog selective for VPAC1 may be an antagonist of VPAC1 receptor. In some embodiments, an analog selective to VPAC1 receptor means that the analog may bind to VPAC2 receptor but has a higher binding affinity for a domain of the VPAC1 receptor if the analog is exposed to both VPAC1 receptor and VPAC2 receptor at similar or equivalent concentrations. As used herein, an analog that selectively binds to PAC1 refers to an analog with increased selectivity for the PAC1 receptor as compared to other known receptors or proteins to which the peptide may bind. In some embodiments, the analog selective for PAC1 may be an agonist of the PAC1 receptor peptide. In some embodiments, the analog selective for PAC1 may be an antagonist of PAC1 receptor. In some embodiments, an analog selective to PAC1 receptor means that the analog may bind to VPAC2 or VPAC1 receptors but has a higher binding affinity for a domain of the PAC1 receptor if the analog is exposed to PAC1, VPAC1 receptor and VPAC2 receptors at similar or equivalent concentrations. The degree of selectivity may be determined by a ratio of VPAC2 receptor binding affinity to VPAC1 receptor binding affinity or by a ratio of VPAC2 receptor binding affinity to PAC1 receptor binding affinity. Binding affinity is determined as described below in Example 1.

In any of the embodiments described below wherein the polypeptide comprises a residue designated f, the residue designated f is D-Phe or L-Phe or S. In some embodiments, the invention relates to compositions or pharmaceutical compositions comprising a VIP analog, wherein the analog comprises an α-amino acid and at least one β-amino acid, and wherein the analog is between 75% and 99% homologous to HfDAVFTNSYRKVLKRLSARKLLQDIL; where residue designated f (position 2) is D-Phe, and wherein the analog interferes with the VPAC1 receptor signaling pathway. In some embodiments, the invention relates to compositions or pharmaceutical compositions comprising a VIP analog, wherein the analog comprises an α-amino acid and at least one β-amino acid, and wherein the analog is between 75% and 99% homologous to HfDAVFTNSYRKVLKRLSARKLLQDIL, where residue designated f (position 2) is D-Phe, and wherein the analog is an antagonist of the VPAC1 receptor. In some embodiments, the composition comprises a VIP analog is from about 80% to about 99% homologous to HfDAVFTNSYRKVLKRLSARKLLQDIL, where residue designated f (position 2) is D-Phe. In some embodiments the VIP analog is from about 80% to about 85% homologous to HfDAVFTNSYRKVLKRLSARKLLQDIL, where residue designated f (position 2) is D-Phe. In some embodiments the VIP analog is from about 85% to about 90% homologous to HfDAVFTNSYRKVLKRLSARKLLQDIL, where residue designated f (position 2) is D-Phe. In some embodiments the VIP analog is from about 90% to about 95% homologous to HfDAVFTNSYRK-VLKRLSARKLLQDIL, where residue designated f (position 2) is D-Phe. In some embodiments the VIP analog is from about 95% to about 99% homologous to HfDAVFTNSYRKVLKRLSARKLLQDIL, where residue designated f (position 2) is D-Phe. In some embodiments the VIP analog is about 95%, 96%, 97%, 98%, or 99% homologous to HfDAVFTNSYRKVLKRLSARKLLQDIL, where residue designated f (position 2) is D-Phe. In some embodiments, the composition or pharmaceutical compositions comprise a VIP analog, wherein the analog is either: (a) an antagonist of VPAC1 receptor; or (b) interferes with VPAC1 receptor signaling pathway and comprises the following repetitive pattern of sequential β-amino acids from the amino-terminus: $\beta_1\alpha_1\alpha_2\beta_2\alpha_3\alpha_4\alpha_5\beta_3\alpha_6\alpha_7\beta_4\alpha_8\alpha_9\alpha_{10}\beta_5$, wherein $\beta_1$=any beta amino acid, $\alpha_1$=any alpha amino acid, $\alpha_2$=any alpha amino acid, $\beta_2$=any beta amino acid, $\alpha_3$=any alpha amino acid, $\alpha_4$=any alpha amino acid; $\alpha_5$=any alpha amino acid, $\beta_3$=any beta amino acid, $\alpha_6$=any alpha amino acid; $\alpha_7$=any alpha amino acid; $\beta_4$=any beta amino acid, $\alpha_8$=any alpha amino acid; $\alpha_9$=any alpha amino acid; $\alpha_{10}$=any alpha amino acid; $\beta_5$=any beta amino acid; wherein the repetitive pattern is, optionally, preceded by: HfDAV FTNSY, and wherein residue designated f (position 2) is D-Phe
wherein the C-terminus is, optionally, amidated; and
wherein the N-terminus is, optionally, acylated;
or functional fragments thereof.

In some embodiments, the composition or pharmaceutical compositions comprise a VIP analog, wherein the analog is either: (a) an antagonist of VPAC1 receptor; or (b) interferes with VPAC1 receptor signaling pathway and comprises the following repetitive pattern of sequential β-amino acids from the amino-terminus: $\beta_1\alpha_1\alpha_2\beta_2\alpha_3\alpha_4\alpha_5\beta_3\alpha_6\alpha_7\beta_4\alpha_8\alpha_9\alpha_{10}\beta_5$, wherein $\beta_1$=any beta 3 amino acid, $\alpha_1$=any alpha amino acid, $\alpha_2$=any alpha amino acid, $\beta_2$=any beta 3 amino acid, $\alpha_3$=any alpha amino acid, $\alpha_4$=any alpha amino acid; $\alpha_5$=any alpha amino acid, $\beta_3$=any beta 3 amino acid, $\alpha_6$=any alpha amino acid; $\alpha_7$=any alpha amino acid; $\beta_4$=any beta 3 amino acid, $\alpha_8$=any alpha amino acid; $\alpha_9$=any alpha amino acid; $\alpha_{10}$=any alpha amino acid; $\beta_5$=any beta 3 amino acid; wherein the repetitive pattern is, optionally, preceded by: HfDAV FTNSY, and wherein residue designated f (position 2) is D-Phe
wherein the C-terminus is, optionally, amidated; and
wherein the N-terminus is, optionally, acylated;
or functional fragments thereof.

In some embodiments, the composition or pharmaceutical compositions comprise a VIP analog, wherein the analog is either: (a) an antagonist of VPAC1 receptor; or (b) interferes with VPAC1 receptor signaling pathway and comprises the following repetitive pattern of sequential β-amino acids from the amino-terminus: $\beta_1\alpha_1\alpha_2\beta_2\alpha_3\alpha_4\alpha_5\beta_3\alpha_6\alpha_7\beta_4\alpha_8\alpha_9\alpha_{10}\beta_5$, wherein $\beta_1$=a beta-3 arginine, $\alpha_1$=any alpha amino acid, $\alpha_2$=any alpha amino acid, $\beta_2$=a beta-3 leucine, $\alpha_3$=any alpha amino acid, $\alpha_4$=any alpha amino acid; $\alpha_5$=any alpha amino acid, $\beta_3$=a beta-3 serine, $\alpha_6$=any alpha amino acid; $\alpha_7$=any alpha amino acid; $\beta_4$=a beta-3 lysine, $\alpha_8$=any alpha amino acid; $\alpha_9$=any alpha amino acid; $\alpha_{10}$=any alpha amino acid; $\beta_5$=a beta-3 aspartic acid; wherein the repetitive pattern is, optionally, preceded by: HfDAV FTNSY; and wherein residue designated f (position 2) is D-Phe
wherein the C-terminus is, optionally, amidated; and
wherein the N-terminus is, optionally, acylated;
or functional fragments thereof.

In some embodiments, the composition comprises HfDAVFTDN or HfDAVFTDNY, wherein at least one of the amino acids from HfDAVFTDN or HfDAVFTDNY are non-natural or beta amino acids, wherein residue designated f (position 2) is D-Phe. In some embodiments, the composition comprises HfDAVFTDN or HfDAVFTDNY, wherein at least one of the amino acids from HfDAVFTDN or HfDAVFTDNY is a beta-3, beta-2, cyclic, or heterocyclic beta amino acids, and wherein residue designated f (position 2) is D-Phe. In some embodiments, the C-terminus is not amidated. In some embodiments, the N-terminus is not acylated. In some embodiments, the composition comprises HfDAVFTDN or HfDAVFTDNY, wherein the amino acids from HfDAVFTDN or HfDAVFTDNY are alpha amino acids, and wherein residue designated f (position 2) is D-Phe. In some embodiments, the composition comprises HfDAVFTDN or HfDAVFTDNY, wherein the amino acids from HfDAVFTDN or HfDAVFTDNY are not alpha amino acids, and wherein residue designated f (position 2) is D-Phe. In some embodiments, the composition comprises HfDAVFTDN or HfDAVFTDNY, wherein none of the amino acids from HfDAVFTDN or HfDAVFTDNY are beta-3 amino acids, and wherein residue designated f (position 2) is D-Phe. In some embodiments, the composition comprises HfDAVFTDN or HfDAVFTDNY, wherein none of the amino acids from HfDAVFTDN or HfDAVFTDNY are beta-2 amino acids, and wherein residue designated f (position 2) is D-Phe. In some embodiments, the composition comprises HfDAVFTDN or HfDAVFTDNY, wherein none of the amino acids from HfDAVFTDN or HfDAVFTDNY are ACPC or APC, and wherein residue designated f (position 2) is D-Phe. In some embodiments, the composition comprises HfDAVFTDN or HfDAVFTDNY, wherein none of the amino acids from HfDAVFTDN or HfDAVFTDNY are cyclic, wherein residue designated f (position 2) is D-Phe. In some embodiments, the composition comprises HfDAVFTDN or HfDAVFTDNY, wherein none of the amino acids from HfDAVFTDN or HfDAVFTDNY are heterocyclic, and wherein residue designated f (position 2) is D-Phe.

In some embodiments, the composition comprises a VIP analog, wherein the analog comprises the following repetitive pattern of sequential β-amino acids from the amino-terminus: $\beta_1\alpha_1\alpha_2\alpha_3\beta_2\alpha_4\alpha_5\beta_3\alpha_6\alpha_7\alpha_8\beta_4\alpha_9\alpha_{10}\beta_5$; wherein $\beta_1$=any beta amino acid; $\alpha_1$=any alpha amino acid, $\alpha_2$=any alpha amino acid, $\alpha_3$=an alpha amino acid, $\beta_2$=any beta amino acid; $\alpha_4$=an alpha alpha amino acid, $\alpha_5$=any alpha amino acid, $\beta_3$=any beta amino acid; $\alpha_6$=any alpha amino acid, $\alpha_7$=any alpha amino acid, $\alpha_8$=any alpha amino acid, $\beta_4$=any beta amino acid; $\alpha_9$=any alpha amino acid, $\alpha_{10}$=any alpha amino acid, $\beta_5$=any beta amino acid; wherein the repetitive pattern is, optionally, preceded by: HfDAV FTNSY or HfDAV FTNS, and wherein the C-terminus is, optionally, amidated; and
wherein the N-terminus is, optionally, acylated;
or functional fragments thereof; and wherein residue designated f (position 2) is D-Phe.

In some embodiments, the composition comprises a VIP analog, wherein the analog comprises the following repetitive pattern of sequential β-amino acids from the amino-terminus: $\beta_1\alpha_1\alpha_2\alpha_3\beta_2\alpha_4\alpha_5\beta_3\alpha_6\alpha_7\alpha_8\beta_4\alpha_9\alpha_{10}\beta_5$; wherein $\beta_1$=a beta-3 arginine or beta-3 tyrosine; $\alpha_1$=any alpha amino acid, $\alpha_2$=any alpha amino acid, $\alpha_3$=an alpha amino acid, $\beta_2$=a beta-3 lysine or beta-3 leucine; $\alpha_4$=an alpha alpha amino acid, $\alpha_5$=any alpha amino acid, $\beta_3$=a beta-3 serine or a beta-3 leucine; $\alpha_6$=any alpha amino acid, $\alpha_7$=any alpha amino acid, $\alpha_8$=any alpha amino acid, $\beta_4$=a beta-3 leucine or beta-3 lysine; α$_9$=any alpha amino acid, α$_{10}$=any alpha amino acid, β$_5$=a beta-3 aspartic acid or beta-3 glutamine; wherein the repetitive pattern is, optionally, preceded by: HfDAV FTNSY or HfDAV FINS, and wherein the C-terminus is, optionally, amidated; and
wherein the N-terminus is, optionally, acylated;
or functional fragments thereof, and wherein residue designated f (position 2) is D-Phe.

In some embodiments, the composition comprises a VIP analog, wherein the analog comprises the following repetitive pattern of sequential β-amino acids from the amino-terminus: β$_1$α$_1$α$_2$α$_3$β$_2$α$_4$α$_5$β$_3$α$_6$α$_7$α$_8$β$_4$α$_9$α$_{10}$β$_5$; wherein β$_1$=a beta-3 arginine, beta-3 tyrosine, or APC; α$_1$=any alpha amino acid, α$_2$=any alpha amino acid, α$_3$=an alpha amino acid, β$_2$=ACPC or APC; α$_4$=an alpha alpha amino acid, α$_5$=any alpha amino acid, β$_3$=ACPC or a beta-3 leucine; α$_6$=any alpha amino acid, α$_7$=any alpha amino acid, α$_8$=any alpha amino acid, β$_4$=a beta-3 leucine, beta-3 lysine, or APC; α$_9$=any alpha amino acid, α$_{10}$=any alpha amino acid, β$_5$=a beta-3 aspartic acid or ACPC; wherein the repetitive pattern is, optionally, preceded by: HfDAV FTNSY or HfDAV FTNS, and wherein the C-terminus is, optionally, amidated; and
wherein the N-terminus is, optionally, acylated;
or functional fragments thereof, and wherein residue designated f (position 2) is D-Phe.

In some embodiments, the invention relates to compositions or pharmaceutical compositions comprising a VIP analog, wherein the analog comprises an α-amino acid and at least one β-amino acid, and wherein the analog is between 75% and 100% homologous to one or more of the following sequences:

```
HfDAV FTNSY ZKVXK RLXAR KLLQD IL

HfDAV FTNSY RKVXK RLXAR ZLLQD IL

HfDAV FTNSY RKVXK RLXAR KLLQX IL

HfDAV FTNSY ZKVXK RLXAR ZLLQX IL

HfDAV FTNSY RKVLZ RLXAR KLLQX IL

HfDAV FTNSY ZKVLZ RLXAR KLLQX IL

HfDAV FTNSY RKVXK RLSAR ZLLXD IL

HfDAV FTNSY RKVXK RXSAR KLLXD IL

HfDAV FTNSY RKVXK RXSAR ZLLXD IL
``` wherein residue designated f (position 2) is D-Phe, wherein each underlined residue is a beta amino acid, wherein X is a ACPC, wherein Z is APC, and wherein the analog interferes with the VPAC1 receptor signaling pathway. In some embodiments, the invention relates to compositions or pharmaceutical compositions comprising a VIP analog, wherein the analog comprises an α-amino acid and at least one β-amino acid, and wherein the analog is between 75% and 100% homologous to one or more of the following sequences:

```
HfDAV FTNSY ZKVXK RLXAR KLLQD IL

HfDAV FTNSY RKVXK RLXAR ZLLQD IL

HfDAV FTNSY RKVXK RLXAR KLLQX IL

HfDAV FTNSY ZKVXK RLXAR ZLLQX IL
```

```
HfDAV FTNSY RKVLZ RLXAR KLLQX IL

HfDAV FTNSY ZKVLZ RLXAR KLLQX IL

HfDAV FTNSY RKVXK RLSAR ZLLXD IL

HfDAV FTNSY RKVXK RXSAR KLLXD IL

HfDAV FTNSY RKVXK RXSAR ZLLXD IL
``` wherein residue designated f (position 2) is D-Phe, wherein each underlined residue is a beta amino acid, wherein X is a ACPC, wherein Z is APC, and wherein the analog is an antagonist of the VPAC1 receptor; or functional fragments thereof.

In some embodiments, the invention relates to compositions or pharmaceutical compositions comprising a VIP analog, wherein the analog comprises an α-amino acid and at least one β-amino acid, and wherein the analog is between 75% and 100% homologous to one or more of the following sequences:

```
HSDAV FTDNY TRLRK QlAVK KYLNa ILN    (SEQ ID NO: 1342)

HSDAV FTDNY tRLrK QLaVK kYLNa Iln    (SEQ ID NO: 1342)

HSDAV FTDNY tRLRk QLaVK KyLNa ILN    (SEQ ID NO: 1342)

HSDAV FTDNY TRLrK QlAVK kYLnA Iln    (SEQ ID NO: 1342)

HSDAV FTDNY tRLzK QLxVK kYLNx ILn    (SEQ ID NO: 1343)

HSDAV FTDNY tRLzK QLxVK zYLNx Iln    (SEQ ID NO: 1344)

HSDAV FTDNY xRLzK QLxVK kYLNx Iln    (SEQ ID NO: 1345)

HSDAV FTDNY xRLzK QLxVK zYLNx Iln    (SEQ ID NO: 1346)

HSDAV FTDNY tRLRz QLxVK KyLNx ILN    (SEQ ID NO: 1347)

HSDAV FTDNY xRLRz QLxVK KyLNx ILN    (SEQ ID NO: 1348)

HSDAV FTDNY TRLzK QlAVK zYLxA Iln    (SEQ ID NO: 1349)

HSDAV FTDNY TRLzK QxAVK kYLxA Iln    (SEQ ID NO: 1350)

HSDAV FTDNY TRLzK QxAVK zYLxA Iln    (SEQ ID NO: 1351)
``` wherein each underlined residue is a beta amino acid corresponding to the single code amino acid upon which it is based, wherein X is a ACPC, and wherein Z is APC; or functional fragments thereof.

In some embodiments, the invention relates to compositions or pharmaceutical compositions comprising a VIP analog, wherein the analog comprises an α-amino acid and at least one β-amino acid, and wherein the analog is between 75% and 99% homologous to HSDAVFTDNYTRL-RKQVAAKKYLQSIKNKRY (SEQ ID NO:433), and wherein the analog stimulates the VPAC2 receptor signaling pathway. In some embodiments, the invention relates to compositions or pharmaceutical compositions comprising a VIP analog, wherein the analog comprises an α-amino acid and at least one β-amino acid, and wherein the analog is between 75% and 99% homologous to HSDAVFTDNY-TRLRKQVAAKKYLQSIKNKRY (SEQ ID NO:433), wherein the analog is an agonist of the VPAC2 receptor. In some embodiments, the composition comprises a VIP analog is from about 80% to about 99% homologous to HSDAVFTDNYTRLRKQVAAKKYLQSIKNKRY (SEQ ID NO:433). In some embodiments the VIP analog is from about 80% to about 85% homologous to HSDAVFTDNY- TRLRKQVAAKKYLQSIKNKRY (SEQ ID NO:433). In some embodiments the VIP analog is from about 85% to about 90% homologous to HSDAVFTDNYTRL-RKQVAAKKYLQSIKNKRY (SEQ ID NO:433). In some embodiments the VIP analog is from about 90% to about 95% homologous to HSDAVFTDNYTRLRKQVAAKKY-LQSIKNKRY (SEQ ID NO:433). In some embodiments the VIP analog is from about 95% to about 99% homologous to HSDAVFTDNYTRLRKQVAAKKYLQSIKNKRY (SEQ ID NO:433). In some embodiments the VIP analog is about 95%, 96%, 97%, 98%, or 99% homologous to HSDAVFTD-NYTRLRKQVAAKKYLQSIKNKRY (SEQ ID NO:433). In some embodiments the VIP analog is HSDAVFTDNY-TRLRKQVAAKKYLQSIKNKRY (SEQ ID NO:433).

In some embodiments, the composition or pharmaceutical composition comprises a VIP analog, wherein the analog comprises the following repetitive pattern of sequential β-amino acids from the amino-terminus: $\beta_1\alpha_1\alpha_2\beta_2\alpha_3\alpha_4\alpha_5\beta_3\alpha_6\alpha_7\beta_4\alpha_8\alpha_9\alpha_{10}\beta_5\alpha_{11}\alpha_{12}\beta_6$, wherein $\beta_1$=any beta amino acid, $\alpha_1$=any alpha amino acid, $\alpha_2$=any alpha amino acid, $\beta_2$=any beta amino acid, $\alpha_3$=any alpha amino acid, $\alpha_4$=any alpha amino acid; $\alpha_5$=any alpha amino acid, $\beta_3$=any beta amino acid, $\alpha_6$=any alpha amino acid; $\alpha_7$=any alpha amino acid; $\beta_4$=any beta amino acid, $\alpha_8$=any alpha amino acid; $\alpha_9$=any alpha amino acid; $\alpha_{10}$=any alpha amino acid; $\beta_5$=any beta amino acid; $\alpha_{13}$=any alpha amino acid, $\alpha_{12}$=any alpha amino acid, $\beta_6$=any beta amino acid; and wherein the repetitive pattern is, optionally, preceded by: HSDAV FTDNY (SEQ ID NO: 1340) or HSDAV FTDN (SEQ ID NO: 1341); and wherein the repetitive pattern is, optionally, succeeded by: K, KR, or KRY wherein the C-terminus is, optionally, amidated; and wherein the N-terminus is unmodified or modified; or functional fragments thereof.

In some embodiments, the composition or pharmaceutical composition comprises a VIP analog, wherein the analog comprises the following repetitive pattern of sequential β-amino acids from the amino-terminus: $\beta_1\alpha_1\alpha_2\beta_2\alpha_3\alpha_4\alpha_5\beta_3\alpha_6\alpha_7\beta_4\alpha_8\alpha_9\alpha_{10}\beta_5\alpha_{11}\alpha_{12}\beta_6$, wherein $\beta_1$=a beta-3 threonine, $\alpha_1$=any alpha amino acid, $\alpha_2$=any alpha amino acid, $\beta_2$=a beta-3 arginine, $\alpha_3$=any alpha amino acid, $\alpha_4$=any alpha amino acid; $\alpha_5$=an alpha leucine, $\beta_3$=a beta-3 alanine, $\alpha_6$=any alpha amino acid; $\alpha_7$=any alpha amino acid; $\beta_4$=a beta-3 lysine, $\alpha_8$=any alpha amino acid; $\alpha_9$=any alpha amino acid; $\alpha_{10}$=any alpha amino acid; $\beta_5$=a beta-3 serine; $\alpha_{11}$=any alpha amino acid, $\alpha_{12}$=any alpha amino acid, $\beta_6$=a beta-3 asparagine; and wherein the repetitive pattern is, optionally, preceded by: HSDAV FTDNY (SEQ ID NO: 1340) or HSDAV FTDN (SEQ ID NO: 1341); and wherein the repetitive pattern is, optionally, succeeded by: K, KR, or KRY wherein the C-terminus is, optionally, amidated; and wherein the N-terminus is unmodified or modified; or functional fragments thereof, wherein the VIP analog or functional fragment thereof is a VPAC2 agonist.

In some embodiments, the composition or pharmaceutical composition comprises a VIP analog, wherein the analog comprises the following repetitive pattern of sequential β-amino acids from the amino-terminus: $\beta_1\alpha_1\alpha_2\beta_2\alpha_3\alpha_4\alpha_5\beta_3\alpha_6\alpha_7\beta_4\alpha_8\alpha_9\alpha_{10}\beta_5\alpha_{11}\alpha_{12}\beta_6$, wherein $\beta_1$=any beta amino acid, $\alpha_1$=any alpha amino acid, $\alpha_2$=any alpha amino acid, $\beta_2$=any beta amino acid, $\alpha_3$=any alpha amino acid, $\alpha_4$=any alpha amino acid; $\alpha_5$=any alpha amino acid, $\beta_3$=any beta amino acid, $\alpha_6$=any alpha amino acid; $\alpha_7$=any alpha amino acid; $\beta_4$=any beta amino acid, $\alpha_8$=any alpha amino acid; $\alpha_9$=any alpha amino acid; $\alpha_{10}$=any alpha amino acid; $\beta_5$=any beta amino acid; $\alpha_{13}$=any alpha amino acid, $\alpha_{12}$=any alpha amino acid, $\beta_6$=any beta amino acid; and wherein the repetitive pattern is, optionally, preceded by: HSDAV FTDNY (SEQ ID NO: 1340) or HSDAV FTDN (SEQ ID NO: 1341); and wherein the repetitive pattern is, optionally, succeeded by: K, KR, or KRY wherein the C-terminus is, optionally, amidated; and wherein the N-terminus is unmodified or modified; or functional fragments thereof and wherein the analog or functional fragment thereof is a VPAC2 agonist.

In some embodiments, the composition or pharmaceutical composition comprises a VIP analog, wherein the analog comprises the following repetitive pattern of sequential β-amino acids from the amino-terminus: $\beta_1\alpha_1\alpha_2\beta_2\alpha_3\alpha_4\alpha_5\beta_3\alpha_6\alpha_7\beta_4\alpha_8\alpha_9\alpha_{10}\beta_5\alpha_{11}\alpha_{12}\beta_6$, wherein $\beta_1$=a beta-3 threonine, $\alpha_1$=any alpha amino acid, $\alpha_2$=any alpha amino acid, $\beta_2$=a beta-3 arginine, $\alpha_3$=any alpha amino acid, $\alpha_4$=any alpha amino acid; $\alpha_5$=any alpha amino acid, $\beta_3$=a beta-3 alanine, $\alpha_6$=any alpha amino acid; $\alpha_7$=any alpha amino acid; $\beta_4$=a beta-3 lysine, $\alpha_8$=any alpha amino acid; $\alpha_9$=any alpha amino acid; $\alpha_{10}$=any alpha amino acid; $\beta_5$=a beta-3 serine; $\alpha_{11}$=any alpha amino acid, $\alpha_{12}$=any alpha amino acid, $\beta_6$=a beta-3 asparagine; and wherein the repetitive pattern is, optionally, preceded by: HSDAVFTDNY (SEQ ID NO: 1340), and wherein the repetitive pattern is, optionally, succeeded by: K, KR, or KRY wherein the C-terminus is, optionally, amidated; and wherein the N-terminus is unmodified or modified; or functional fragments thereof.

In some embodiments, the composition comprises a VIP analog, wherein the analog comprises the following repetitive pattern of sequential β-amino acids from the amino-terminus: $\beta_1\alpha_1\alpha_2\alpha_3\alpha_2\alpha_4\alpha_5\beta_3\alpha_6+_7\alpha_8\beta_4\alpha_9\alpha_{10}\beta_5\alpha_{11}\alpha_{12}\alpha_{13}\beta_6$; wherein $\beta_1$=any beta amino acid; $\alpha_1$=any alpha amino acid, $\alpha_2$=any alpha amino acid, $\alpha_3$=an alpha amino acid, $\beta_2$=any beta amino acid; $\alpha_4$=an alpha alpha amino acid, $\alpha_5$=any alpha amino acid, $\beta_3$=any beta amino acid; $\alpha_6$=any alpha amino acid, $\alpha_7$=any alpha amino acid, $\alpha_8$=any alpha amino acid, $\beta_4$=any beta amino acid; $\alpha_9$=any alpha amino acid, $\alpha_{10}$=any alpha amino acid, $\beta_5$=any beta amino acid; $\alpha_{11}$=any alpha amino acid, $\alpha_{12}$=any alpha amino acid, $\alpha_{13}$=any alpha amino acid; and $\beta_6$=any beta amino acid; and wherein the repetitive pattern is, optionally, preceded by: HSDAV FTDNY (SEQ ID NO: 1340) or HSDAV FTDN (SEQ ID NO: 1341); and wherein the repetitive pattern is, optionally, succeeded by: K, KR, or KRY wherein the C-terminus is, optionally, amidated; and wherein the N-terminus is unmodified or modified; or functional fragments thereof.

In some embodiments, the composition comprises a VIP analog, wherein the analog comprises the following repetitive pattern of sequential β-amino acids from the amino-terminus: $\beta_1\alpha_1\alpha_2\alpha_3\beta_2\alpha_4+_5\beta_3\alpha_6\alpha_7\alpha_8\beta_4\alpha_9\alpha_{10}\beta_5\alpha_{11}\alpha_{12}\alpha_{13}\beta_6$; wherein $\beta_1$=a beta-3 threonine or a beta-3 tyrosine; $\alpha_1$=any alpha amino acid, $\alpha_2$=any alpha amino acid, $\alpha_3$=an alpha amino acid, $\beta_2$=a beta-3 lysine or a beta-3 arginine; $\alpha_4$=an alpha alpha amino acid, $\alpha_5$=any alpha amino acid, $\beta_3$=a beta-3 alanine or a beta-3 valine; $\alpha_6$=any alpha amino acid, $\alpha_7$=any alpha amino acid, $\alpha_8$=any alpha amino acid, $\beta_4$=a beta-3 tyrosine or a beta-3 lysine; $\alpha_9$=any alpha amino acid, $\alpha_{10}$=any alpha amino acid, $\beta_5$=a beta-3 serine or a beta-3 glutamine; $\alpha_{11}$=any alpha amino acid, $\alpha_{12}$=any alpha amino acid, $\alpha_{13}$=any alpha amino acid; and $\beta_6$=a beta-3 lysine or a beta-3 asparagine; and wherein the repetitive pattern is, optionally, preceded by: HSDAV FTDNY (SEQ ID NO: 1340) or HSDAV FTDN (SEQ ID NO: 1341); and wherein the repetitive pattern is, optionally, succeeded by: K, KR, or KRY wherein the C-terminus is, optionally, amidated; and wherein the N-terminus is unmodified or modified; or functional fragments thereof.

In some embodiments, the composition comprises a VIP analog, wherein the analog comprises the following repetitive pattern of sequential β-amino acids from the amino-terminus: $\beta_1\alpha_1\alpha_2\alpha_3\beta_2\alpha_4\alpha_5\beta_3\alpha_6\alpha_7\alpha_8\beta_4\alpha_9\alpha_{10}\beta_5+_{11}\alpha_{12}\alpha_{13}\beta_6$; wherein $\alpha_1$=a beta-3 threonine or a beta-3 tyrosine; $\alpha_1$=any alpha amino acid, $\alpha_2$=any alpha amino acid, $\alpha_3$=an alpha amino acid, $\beta_2$=a beta-3 lysine or a beta-3 arginine; $\alpha_4$=an alpha alpha amino acid, $\alpha_5$=any alpha amino acid, $\beta_3$=a beta-3 alanine or a beta-3 valine; $\alpha_6$=any alpha amino acid, $\alpha_7$=any alpha amino acid, $\alpha_8$=any alpha amino acid, $\beta_4$=a beta-3 tyrosine or a beta-3 lysine; $\alpha_9$=any alpha amino acid, $\alpha_{10}$=any alpha amino acid, $\beta_5$=a beta-3 serine or a beta-3 glutamine; $\alpha_{11}$=any alpha amino acid, $\alpha_{12}$=any alpha amino acid, $\alpha_{13}$=any alpha amino acid; and $\beta_6$=a beta-3 lysine or a beta-3 asparagine; and wherein the repetitive pattern is, optionally, preceded by: HSDAV FTDNY (SEQ ID NO: 1340) or HSDAV FTDN (SEQ ID NO: 1341); and wherein the repetitive pattern is, optionally, succeeded by: K, KR, or KRY.

wherein the C-terminus is, optionally, amidated; and wherein the N-terminus is unmodified or modified; or functional fragments thereof.

and wherein the analog or functional fragment thereof is a VPAC2 agonist.

In some embodiments, the invention relates to compositions or pharmaceutical compositions comprising a VIP analog, wherein the analog comprises an α-amino acid and at least one β-amino acid, and wherein the analog is between 75% and 100% homologous to one or more of the following sequences:

```
HSDAVFTDNYXRLZKQVXAKKYLQSIKNKRY    (SEQ ID NO: 1353)
HSDAVFTDNYTRLZKQVXAKZYLQSIKNKRY    (SEQ ID NO: 1354)
HSDAVFTDNYTRLZKQVXAKKYLQXIKNKRY    (SEQ ID NO: 1355)
HSDAVFTDNYXRLZKQVXAKZYLQXIKXKRY    (SEQ ID NO: 1356)
HSDAVFTDNYTRLRZQVXAKKYLQXIKNKRY    (SEQ ID NO: 1357)
HSDAVFTDNYXRLRZQVXAKKYLQXIKNKRY    (SEQ ID NO: 1358)
HSDAVFTDNYTRLZKQVSAKZYLXSIKNKRY    (SEQ ID NO: 1359)
HSDAVFTDNYTRLZKQXSAKKYLXSIKNKRY    (SEQ ID NO: 1360)
HSDAVFTDNYTRLZKQXSAKZYLXSIKNKRY    (SEQ ID NO: 1361)
``` wherein each underlined residue is a beta amino acid corresponding to the single code amino acid upon which it is based, wherein X is a ACPC, and wherein Z is APC; or functional fragments thereof; wherein the C-terminus is, optionally, amidated; and wherein the N-terminus is unmodified.

In some embodiments, the invention relates to compositions or pharmaceutical compositions comprising a VIP analog, wherein the analog comprises an α-amino acid and at least one β-amino acid, and wherein the analog is between 75% and 100% homologous to one or more of the following sequences:

```
HSDAVFTDNYXRLZKQVXAKKYLQSIKNKRY    (SEQ ID NO: 1353)
HSDAVFTDNYTRLZKQVXAKZYLQSIKNKRY    (SEQ ID NO: 1354)
HSDAVFTDNYTRLZKQVXAKKYLQXIKNKRY    (SEQ ID NO: 1355)
HSDAVFTDNYXRLZKQVXAKZYLQXIKXKRY    (SEQ ID NO: 1356)
HSDAVFTDNYTRLRZQVXAKKYLQXIKNKRY    (SEQ ID NO: 1357)
HSDAVFTDNYXRLRZQVXAKKYLQXIKNKRY    (SEQ ID NO: 1358)
HSDAVFTDNYTRLZKQVSAKZYLXSIKNKRY    (SEQ ID NO: 1359)
HSDAVFTDNYTRLZKQXSAKKYLXSIKNKRY    (SEQ ID NO: 1360)
HSDAVFTDNYTRLZKQXSAKZYLXSIKNKRY    (SEQ ID NO: 1361)
``` wherein each underlined residue is a beta amino acid corresponding to the single code amino acid upon which it is based, wherein X is a ACPC, and wherein Z is APC; or functional fragments thereof; wherein the C-terminus is, optionally, amidated; and wherein the N-terminus is, optionally, modified.

In some embodiments, the invention relates to compositions or pharmaceutical compositions comprising a VIP analog, wherein the analog comprises an α-amino acid and at least one β-amino acid, and wherein the analog is between 75% and 100% homologous to one or more of the following sequences:

```
HSDAVFTDNYXRLZKQVXAKKYLQSIKNKRY    (SEQ ID NO: 1353)
HSDAVFTDNYTRLZKQVXAKZYLQSIKNKRY    (SEQ ID NO: 1354)
HSDAVFTDNYTRLZKQVXAKKYLQXIKNKRY    (SEQ ID NO: 1355)
HSDAVFTDNYXRLZKQVXAKZYLQXIKXKRY    (SEQ ID NO: 1356)
HSDAVFTDNYTRLRZQVXAKKYLQXIKNKRY    (SEQ ID NO: 1357)
HSDAVFTDNYXRLRZQVXAKKYLQXIKNKRY    (SEQ ID NO: 1358)
HSDAVFTDNYTRLZKQVSAKZYLXSIKNKRY    (SEQ ID NO: 1359)
HSDAVFTDNYTRLZKQXSAKKYLXSIKNKRY    (SEQ ID NO: 1360)
HSDAVFTDNYTRLZKQXSAKZYLXSIKNKRY    (SEQ ID NO: 1361)
``` wherein each underlined residue is a beta amino acid corresponding to the single code amino acid upon which it is based, wherein X is a ACPC, and wherein Z is APC; or functional fragments thereof; wherein the C-terminus is, optionally, amidated; wherein the N-terminus is, optionally, modified; and wherein the VIP analog or functional fragment thereof is a VPAC2 agonist.

In some embodiments, the invention relates to compositions or pharmaceutical compositions comprising a VIP analog, wherein the analog comprises an α-amino acid and at least one β-amino acid, and wherein the analog is between 75% and 100% homologous to one or more of the following sequences:

```
HSDAVFTDNYTRLRKQVAAKKYLQSIKNKR Y   (SEQ ID NO: 433)
HSDAVFTDNYTRLRKQVAAKKYLQSIKNKR Y   (SEQ ID NO: 433)
HSDAVFTDNYTRLRKQVAAKKYLQSIKNKR Y   (SEQ ID NO: 433)
HSDAVFTDNYXRLZKQVXAKKYLQSIKNKRY    (SEQ ID NO: 1353)
HSDAVFTDNYTRLZKQVXAKZYLQSIKNKRY    (SEQ ID NO: 1354)
```

```
HSDAVFTDNYTRLZKQVXAKKYLQXIKNKRY    (SEQ ID NO: 1355)
HSDAVFTDNYXRLZKQVXAKZYLQXIKXKRY    (SEQ ID NO: 1356)
HSDAVFTDNYTRLRZQVXAKKYLQXIKNKRY    (SEQ ID NO: 1357)
HSDAVFTDNYXRLRZQVXAKKYLQXIKNKRY    (SEQ ID NO: 1358)
HSDAVFTDNYTRLZKQVAAKZYLXSIKNKRY    (SEQ ID NO: 1359)
HSDAVFTDNYTRLZKQXAAKKYLXSIKNKRY    (SEQ ID NO: 1360)
HSDAVFTDNYTRLZKQXAAKZYLXSIKNKRY    (SEQ ID NO: 1361)
``` wherein each underlined residue is an unnatural amino acid corresponding to the single code amino acid upon which it is based, wherein X is a ACPC, and wherein Z is APC; or functional fragments thereof; wherein the C-terminus is, optionally, amidated; wherein the N-terminus is, optionally, modified; and wherein the VIP analog or functional fragment thereof is a VPAC1 agonist.

In some embodiments, the invention relates to compositions or pharmaceutical compositions comprising a VIP analog, wherein the analog comprises an α-amino acid and at least one β-amino acid, and wherein the analog is between 75% and 100% homologous to one or more of the following sequences:

HSDAVFTDNYTRLRKQVAAKKYLQSIKNKR Y (SEQ ID NO: 433)

HSDAVFTDNYTRLRKQVAAKKYLQSIKNKR Y (SEQ ID NO: 433)

HSDAVFTDNYTRLRKQVAAKKYLQSIKNKR Y (SEQ ID NO: 433)

HSDAVFTDNYXRLZKQVXAKKYLQSIKNKRY (SEQ ID NO: 1353)

HSDAVFTDNYTRLZKQVXAKZYLQSIKNKRY (SEQ ID NO: 1354)

HSDAVFTDNYTRLZKQVXAKKYLQXIKNKRY (SEQ ID NO: 1355)

HSDAVFTDNYXRLZKQVXAKZYLQXIKXKRY (SEQ ID NO: 1356)

HSDAVFTDNYTRLRZQVXAKKYLQXIKNKRY (SEQ ID NO: 1357)

HSDAVFTDNYXRLRZQVXAKKYLQXIKNKRY (SEQ ID NO: 1358)

HSDAVFTDNYTRLZKQVAAKZYLXSIKNKRY (SEQ ID NO: 1359)

HSDAVFTDNYTRLZKQXAAKKYLXSIKNKRY (SEQ ID NO: 1360)

HSDAVFTDNYTRLZKQXAAKZYLXSIKNKRY (SEQ ID NO: 1361)

wherein each underlined residue is a beta amino acid corresponding to the single code amino acid upon which it is based, wherein X is a ACPC, and wherein Z is APC; or functional fragments thereof; wherein the C-terminus is, optionally, amidated; wherein the N-terminus is, optionally, modified; and wherein the VIP analog or functional fragment thereof is a VPAC1 agonist.

In some embodiments, the invention relates to compositions or pharmaceutical compositions comprising a VIP analog, wherein the analog comprises an α-amino acid and at least one β-amino acid, and wherein the analog is between 75% and 100% homologous to one or more of the following sequences:

HSDAVFTDNYTRLRKQVAAKKYLQSIKNKR Y (SEQ ID NO: 433)

HSDAVFTDNYTRLRKQVAAKKYLQSIKNKR Y (SEQ ID NO: 433)

HSDAVFTDNYTRLRKQVAAKKYLQSIKNKR Y (SEQ ID NO: 433)

-continued

HSDAVFTDNYXRLZKQVXAKKYLQSIKNKRY (SEQ ID NO: 1353)

HSDAVFTDNYTRLZKQVXAKZYLQSIKNKRY (SEQ ID NO: 1354)

HSDAVFTDNYTRLZKQVXAKKYLQXIKNKRY (SEQ ID NO: 1355)

HSDAVFTDNYXRLZKQVXAKZYLQXIKXKRY (SEQ ID NO: 1356)

HSDAVFTDNYTRLRZQVXAKKYLQXIKNKRY (SEQ ID NO: 1357)

HSDAVFTDNYXRLRZQVXAKKYLQXIKNKRY (SEQ ID NO: 1358)

HSDAVFTDNYTRLZKQVAAKZYLXSIKNKRY (SEQ ID NO: 1359)

HSDAVFTDNYTRLZKQXAAKKYLXSIKNKRY (SEQ ID NO: 1360)

HSDAVFTDNYTRLZKQXAAKZYLXSIKNKRY (SEQ ID NO: 1361)

wherein each underlined residue is a beta-3 homo amino acid corresponding to the single code amino acid upon which it is based, wherein X is a ACPC, and wherein Z is APC; or functional fragments thereof; wherein the C-terminus is, optionally, amidated; wherein the N-terminus is, optionally, modified; and wherein the VIP analog or functional fragment thereof is a VPAC1 agonist.

In some embodiments, the invention relates to compositions or pharmaceutical compositions comprising a VIP analog, wherein the analog comprises an α-amino acid and at least one β-amino acid, and wherein the analog comprises an amino acid sequence that is between 75% and 100% homologous to one or more of the following sequences:

HSDAVFTDNYTRLRKQVAAKKYLQSIKNKR Y (SEQ ID NO: 433)

HSDAVFTDNYTRLRKQVAAKKYLQSIKNKR Y (SEQ ID NO: 433)

HSDAVFTDNYTRLRKQVAAKKYLQSIKNKR Y (SEQ ID NO: 433)

HSDAVFTDNYXRLZKQVXAKKYLQSIKNKRY (SEQ ID NO: 1353)

HSDAVFTDNYTRLZKQVXAKZYLQSIKNKRY (SEQ ID NO: 1354)

HSDAVFTDNYTRLZKQVXAKKYLQXIKNKRY (SEQ ID NO: 1355)

HSDAVFTDNYXRLZKQVXAKZYLQXIKXKRY (SEQ ID NO: 1356)

HSDAVFTDNYTRLRZQVXAKKYLQXIKNKRY (SEQ ID NO: 1357)

HSDAVFTDNYXRLRZQVXAKKYLQXIKNKRY (SEQ ID NO: 1358)

HSDAVFTDNYTRLZKQVAAKZYLXSIKNKRY (SEQ ID NO: 1359)

HSDAVFTDNYTRLZKQXAAKKYLXSIKNKRY (SEQ ID NO: 1360)

HSDAVFTDNYTRLZKQXAAKZYLXSIKNKRY (SEQ ID NO: 1361)

wherein each underlined residue is any unnatural amino acid; any beta-2 amino acid; any beta-3 amino acid; or a beta-3 homo amino acid corresponding to the single code amino acid upon which it is based; wherein X is a ACPC, and wherein Z is APC; or functional fragments thereof; wherein the C-terminus is, optionally, amidated; wherein the N-terminus is, optionally, modified; and wherein the VIP analog or functional fragment thereof is a VPAC1 or VPAC2 agonist.

In some embodiments, the invention relates to compositions or pharmaceutical compositions comprising a VIP analog, wherein the analog comprises an α-amino acid and at least one β-amino acid, and wherein the analog comprises an amino acid sequence that is between 75% and 100% homologous to:

HSDAVFTDNYTRLRKQVAAKKYLQSIKNKRY (SEQ ID NO: 433)

or functional fragments thereof; and wherein the VIP analog or functional fragment thereof is a VPAC2 agonist.

In some embodiments, the invention relates to compositions or pharmaceutical compositions comprising a VIP analog, wherein the analog comprises an α-amino acid and at least one β-amino acid, and wherein the analog comprises an amino acid sequence that is between 75% and 100% homologous to any of the amino acid sequence provided in this application.

The invention relates to methods of manufacturing a composition comprising an analog, wherein the analog comprises an α-amino acid and at least one β-amino acid. In some embodiments, the invention relates to methods of manufacturing a composition comprising an analog, wherein the analog comprises an α-amino acid, at least one β-amino acid, and at least one modified amino acid residue comprising ACPC or APC. The invention relates to methods of manufacturing a composition comprising a secretin family analog, wherein the secretin family analog comprises an α-amino acid and at least one β-amino acid. The invention relates to methods of manufacturing a composition comprising a VIP analog, wherein the VIP analog comprises an α-amino acid and at least one β-amino acid. The method used to fabricate polypeptide compounds may be any means of polypeptide synthesis. Using methods of peptide synthesis, polypeptides fabricated according to the present method are generally less than about 100 residues long. In some embodiments, the invention relates to a method of manufacturing an analog (or fragments herein) comprising non-natural amino acids from about 5 total residues to about 50 total residues, from about 10 total residues to about 20 total residues, from about 20 total residues to about 30 total residues, from about 30 total residues to about 40 total residues, from about 40 total residues to about 50 total residues, from about 50 to about 60 total residues, from about 60 to about 70 total residues from about 70 to about 80 total residues, from about 80 to about 90 total residues, and from about 90 to about 100 total residues. Ranges above and below these stated ranges are within the scope of the invention. Many commercial services, such as Abgent (San Diego, Calif., USA) offer peptide synthesis services up to about 100 residues. In some embodiments, the invention relates to a method of manufacturing an analog comprising no more than 100 non-natural amino acids. In some embodiments, the invention relates to a method of manufacturing an analog comprising no more than 90 non-natural amino acids. In some embodiments, the invention relates to a method of manufacturing an analog comprising no more than 80 non-natural amino acids. In some embodiments, the invention relates to a method of manufacturing an analog comprising no more than 70 non-natural amino acids. In some embodiments, the invention relates to a method of manufacturing an analog comprising no more than 60 non-natural amino acids. In some embodiments, the invention relates to a method of manufacturing an analog comprising no more than 50 non-natural amino acids. In some embodiments, the invention relates to a method of manufacturing an analog comprising no more than 40 non-natural amino acids. In some embodiments, the invention relates to a method of manufacturing an analog comprising no more than 30 non-natural amino acids. In some embodiments, the invention relates to a method of manufacturing an analog comprising no more than 20 non-natural amino acids. In some embodiments, the invention relates to a method of manufacturing an analog comprising no more than 10 non-natural amino acids. In some embodiments, the method of manufacturing the analog comprises synthesizing the analog using at least one, and, in some embodiments, a plurality of the following non-naturally occurring amino acid residues: (2S,3R)-3-(amino)-2-hydroxy-4-(4-nitrophenyl)butyric acid, (2R,3R)-3-(amino)-2-hydroxy-4-phenylbutyric acid, (R)-3-(amino)-5-phenylpentanoic acid, (R)-3-(amino)-4-(2-naphthyl)butyric acid, (R)-2-methyl-β-Phe-OH, (R)-3,4-dimethoxy-β-Phe-OH, (R)-(3-pyridyl)-β-Ala-OH, (R)-3-(trifluoromethyl)-β-Phe-OH, (R)-3-cyano-β-Phe-OH, (R)-3-methoxy-β-Phe-OH, (R)-3-methyl-β-Phe-OH, (R)-4-(4-pyridyl)β-HomoAla-OH, (R)-4-(trifluoromethyl)-β-HomoPhe-OH, (R)-4-(trifluoromethyl)-β-Phe-OH, (R)-4-bromo-β-Phe-OH, (R)-4-chloro-β-HomoPhe-OH, (R)-4-chloro-β-Phe-OH, (R)-4-cyano-β-HomoPhe-OH, (R)-4-cyano-β-Phe-OH, (R)-4-fluoro-β-Phe-OH, (R)-4-methoxy-β-Phe-OH, (R)-4-methyl-β-Phe-OH, (R)-β-Tyr-OH, (R)-4-(3-pyridyl)-O-HomoAla-OH, (R)-4-fluoro-β-HomoPhe-OH, (S)-5-phenylpentanoic acid, (S)-5-hexenoic acid, (S)-5-phenyl-pentanoic acid, (S)-6-phenyl-5-hexenoic acid, (S)-2-(trifluoromethyl)-β-HomoPhe-OH, (S)-2-(trifluoromethyl)-O-Phe-OH, (S)-2-cyano-β-HomoPhe-OH, (S)-2-methyl-β-Phe-OH, (S)-3,4-dimethoxy-β-Phe-OH, (S)-3-(trifluoromethyl)-O-HomoPhe-OH, (S)-3-(trifluoromethyl)-O-Phe-OH, (S)-3-cyano-β-Phe-OH, (S)-3-methoxy-β-Phe-OH, (S)-3-methyl-β-Phe-OH, (S)-4-(4-pyridyl)-O-HomoAla-OH, (S)-4-(trifluoromethyl)-β-Phe-OH, (S)-4-bromo-β-Phe-OH, (S)-4-chloro-β-HomoPhe-OH, (S)-4-chloro-β-Phe-OH, (S)-4-cyano-β-HomoPhe-OH, (S)-4-cyano-β-Phe-OH, (S)-4-fluoro-β-Phe-OH, (S)-4-iodo-β-HomoPhe-OH, (S)-4-methyl-β-HomoPhe-OH, (S)-4-methyl-β-Phe-OH, (S)-β-Tyr-OH, (S)-γ,γ-diphenyl-β-HomoAla-OH, (S)-2-methyl-β-Homophe-OH, (S)-3,4-difluoro-β-HomoPhe-OH, (S)-3-(trifluoromethyl)-O-HomoPhe-OH, (S)-3-cyano-β-HomoPhe-OH, (S)-3-methyl-β-HomoPhe-OH, (S)-γ,γ-diphenyl-β-HomoAla-OH, 3-Amino-3-(3-bromophenyl)propionic acid, and 3-Amino-4,4,4-trifluorobutyric acid.

In some embodiments, the fragment comprises 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 30, 31, 32, 33, 34, 35, 36, 37, 38, 39, or 40 amino acids of the wild type protein sequence. In some embodiments, the fragment comprises any of the above-mentioned numbers of amino acids located anywhere within the peptide. Thus, one skilled in the art understands that a fragment of any of these lengths can be walked along the length of the peptide, thus providing any fragment of the peptide with the same or similar function as the native or wild-type amino acid sequence.

One of ordinary skill in the art would readily appreciate that the protecting groups would be removed from the final chemical structure of the analog which becomes administered to a subject. One of ordinary skill would be able to predict the final chemical structure of the analog by using the protecting groups selectively to create a polypeptide with a desirable chirality or secondary structure. For instance, if the analog of the composition is manufactured using (S)-Fmoc-3-methyl-β-HomoPhe-OH, the final yielded product should comprise at least one β-amino acid residue of a 3-methyl-β-homophenylalanine.

In some embodiments, the method of manufacturing the analog comprises synthesizing the analog using at least one, and in some embodiments, a plurality of cyclic amino acid residues. In some embodiments, the VIP analog of the claimed invention comprises the cyclic amino acid residues. In some embodiments, the VIP analog of the claimed invention comprises at least one disulfide bridge that forms a cyclic chain of atoms along a side chain of two amino acid residues.

In some embodiments, the VIP analog of the claimed invention comprises the following sequence:

```
HSDAVFTDNYTRLRKQMAVKKYLNSILN;        (SEQ ID NO: 10)
``` wherein at least one of the amino acid residues is a β-amino acid residue, and at least one of the amino acid residues is an α-amino acid residue. In some embodiments, the at least one α-amino acid residue is a non-natural amino acid residue. In some embodiments, the amino acid residues at positions 1, 3, 6, 7, 10, and 23 of the VIP analog are not alanine, glycine, or any β amino acid residue with a methyl side chain.

In some embodiments, the VIP analog of the claimed invention comprises the following sequence:

```
                                     (SEQ ID NO: 1362)
HSDAVFX1X2NYTRLRX3QX4AX5X6X7YLNX8IX9X10
``` wherein any of $X_1$, $X_2$, $X_3$, $X_4$, $X_5$, $X_6$, $X_7$, $X_8$, $X_9$, or $X_{10}$ may be a beta-amino acid. In some embodiments, the VIP analog of the claimed invention comprises the following sequence:

```
                                     (SEQ ID NO: 1362)
HSDAVFX1X2NYTRLRX3QX4AX5X6X7YLNX8IX9X10
``` wherein any of $X_1$, $X_2$, $X_3$, $X_4$, $X_5$, $X_6$, $X_7$, $X_8$, $X_9$, or $X_{10}$ are a $\beta^3$-amino acid residue. In some embodiments, at least one of the $\beta^3$-amino acid residues is substituted with a residue chosen from the following: (S,S)-trans-2-aminocyclopentanecarboxylic acid ((S,S)-ACPC), (S,R)-trans-2-aminocyclopentanecarboxylic acid ((S,R)-ACPC), (R,S)-trans-2-aminocyclopentanecarboxylic acid ((R,S)-ACPC), or (R,R)-trans-2-aminocyclopentanecarboxylic acid ((R,R)-ACPC) if the amino acid is non-polar; or pyrrolidine analogue of (S,S)-ACPC, (R,S)-ACPC, (S,R)-ACPC, (R,R)-ACPC), which is designated APC, if the amino acid is basic. In some embodiments, at least one of the $\beta^3$-amino acid residues is substituted with a residue chosen from the following: (S,S)-trans-2-aminocyclopentanecarboxylic acid ((S,S)-ACPC) if the amino acid is non-polar; or pyrrolidine analogue of (S,S)-ACPC if the residue is basic.

In some embodiments, the VIP analog of the claimed invention comprises the following sequence:

```
                                     (SEQ ID NO: 1362)
HSDAVFX1X2NYTRLRX3QX4AX5X6X7YLNX8IX9X10
``` wherein any one or more of $X_1$, $X_2$, $X_3$, $X_4$, $X_5$, $X_6$, $X_7$, $X_8$, $X_9$, or $X_{10}$ is a beta-amino acid, and wherein $X_1$=T; $X_2$=D; $X_3$=R or K; $X_4$=M or L; $X_5$=A or V; $X_6$=R or K; $X_7$=R or K; $X_8$=S or A; $X_9$=L or K; and $X_{10}$=N or K. In some embodiments, the VIP analog of the claimed invention comprises the following sequence:

```
                                     (SEQ ID NO: 1362)
HSDAVFX1X2NYTRLRX3QX4AX5X6X7YLNX8IX9X10
``` wherein any one of $X_1$, $X_2$, $X_3$, $X_4$, $X_5$, $X_6$, $X_7$, $X_8$, $X_9$, or $X_{10}$ is a $\beta^3$-amino acid residue. In some embodiments, at least one of the $\beta^3$-amino acid residues is substituted with a residue chosen from the following: (S,S)-trans-2-aminocyclopentanecarboxylic acid ((S,S)-ACPC), (S,R)-trans-2-aminocyclopentanecarboxylic acid ((S,R)-ACPC), (R,S)-trans-2-aminocyclopentanecarboxylic acid ((R,S)-ACPC), or (R,R)-trans-2-aminocyclopentanecarboxylic acid ((R,R)-ACPC) if the amino acid is non-polar; or pyrrolidine analogue of (S,S)-ACPC, (R,S)-ACPC, (S,R)-ACPC, (R,R)-ACPC), which is designated APC, if the amino acid is basic. In some embodiments, at least one of the $\beta^3$-amino acid residues is substituted with a residue chosen from the following: (S,S)-trans-2-aminocyclopentanecarboxylic acid ((S,S)-ACPC) if the amino acid is non-polar; or pyrrolidine analogue of (S,S)-ACPC if the residue is basic.

In some embodiments, the VIP analog of the claimed invention comprises the following sequence:

```
                                     (SEQ ID NO: 1362)
HSDAVFX1X2NYTRLRX3QX4AX5X6X7YLNX8IX9X10
``` wherein any one or more of $X_1$, $X_2$, $X_3$, $X_4$, $X_5$, $X_6$, $X_7$, $X_8$, $X_9$, or $X_{10}$ is a beta-amino acid, and wherein $X_1$=T; $X_2$=D; $X_3$=R or K; $X_4$=M or L; $X_5$=A or V; $X_6$=R or K; $X_7$=R or K; $X_8$=S or A; $X_9$=L or K; and $X_{10}$=N or K. In some embodiments, the VIP analog of the claimed invention comprises the following sequence:

```
                                     (SEQ ID NO: 1362)
HSDAVFX1X2NYTRLRX3QX4AX5X6X7YLNX8IX9X10
``` wherein any one or more of $X_1$, $X_2$, $X_3$, $X_4$, $X_5$, $X_6$, $X_7$, $X_8$, $X_9$, or $X_{10}$ is a $\beta^3$-amino acid residue. In some embodiments, at least one of the $\beta^3$-amino acid residues is substituted with a residue chosen from the following: (S,S)-trans-2-aminocyclopentanecarboxylic acid ((S,S)-ACPC), (S,R)-trans-2-aminocyclopentanecarboxylic acid ((S,R)-ACPC), (R,S)-trans-2-aminocyclopentanecarboxylic acid ((R,S)-ACPC), or (R,R)-trans-2-aminocyclopentanecarboxylic acid ((R,R)-ACPC) if the amino acid is non-polar; or pyrrolidine analogue of (S,S)-ACPC, (R,S)-ACPC, (S,R)-ACPC, (R,R)-ACPC), which is designated APC, if the amino acid is basic. In some embodiments, at least one of the $\beta^3$-amino acid residues is substituted with a residue chosen from the following: (S,S)-trans-2-aminocyclopentanecarboxylic acid ((S,S)-ACPC) if the amino acid is non-polar; or pyrrolidine analogue of (S,S)-ACPC if the residue is basic.

In some embodiments, the VIP analog of the claimed invention comprises the following sequence:

```
                                     (SEQ ID NO: 1363)
HSDAVFX1X2NYX3RLX4X5QX6X7X8X9X10YLNX11IX12X13
``` wherein $X_3$, $X_4$, $X_7$, $X_{10}$, and $X_{11}$ are beta-amino acid residues derived from the naturally occurring α-amino acid residue at that position, and wherein $X_1$=T; $X_2$=D; $X_5$=R or K; $X_6$=M or L; $X_8$=A or V; $X_9$=R or K; $X_{10}$=R or K; $X_{11}$=S or A; $X_{12}$=L or K; and $X_{13}$=N or K. HSDAVFX1X2NYX3RLX4X5QX6X7X8X9X10YLNX11IX12X13 (SEQ ID NO: 1363) wherein $X_3$, $X_4$, $X_7$, $X_{10}$, and $X_{11}$ are $\beta^3$-amino acid residues derived from the naturally occurring α-amino acid residue at that position. In some embodiments, at least one of the $\beta^3$-amino acid residues is substituted with a residue chosen from the following: (S,S)-trans-2-aminocyclopentanecarboxylic acid ((S,S)-ACPC), (S,R)-trans-2- aminocyclopentanecarboxylic acid ((S,R)-ACPC), (R,S)-trans-2-aminocyclopentanecarboxylic acid ((R,S)-ACPC), or (R,R)-trans-2-aminocyclopentanecarboxylic acid ((R,R)-ACPC) if the amino acid is non-polar; or pyrrolidine analogue of (S,S)-ACPC, (R,S)-ACPC, (S,R)-ACPC, (R,R)-ACPC), which is designated APC, if the amino acid is basic. In some embodiments, at least one of the $\beta^3$-amino acid residues is substituted with a residue chosen from the following: (S,S)-trans-2-aminocyclopentanecarboxylic acid ((S,S)-ACPC) if the amino acid is non-polar; or pyrrolidine analogue of (S,S)-ACPC if the residue is basic.

In some embodiments, the VIP analog of the claimed invention comprises the following sequence:

(SEQ ID NO: 1363)
HSDAVF$X_1X_2$NYX3RL$X4X_5$Q$X_6X7X_8X_9$X10YLNX11I$X_{12}X_{13}$ wherein at least one of $X_1$, $X_2$, $X_3$, $X_4$, $X_5$, $X_6$, $X_7$, $X_8$, $X_9$, $X_{10}$, $X_{11}$, $X_{12}$, or $X_{13}$ is a beta-amino acid, and wherein $X_1$=T; $X_2$=D; $X_5$=R or K; $X_6$=M or L; $X_8$=A or V; $X_9$=R or K; $X_{10}$=R or K; $X_{11}$=S or A; $X_{12}$=L or K; and $X_{13}$=N or K. In some embodiments, the VIP analog of the claimed invention comprises the following sequence:

(SEQ ID NO: 1363)
HSDAVF$X_1X_2$NYX3RL$X4X_5$Q$X_6X7X_8X_9$X10YLNX11I$X_{12}X_{13}$ wherein at least one of $X_1$, $X_2$, $X_3$, $X_4$, $X_5$, $X_6$, $X_7$, $X_8$, $X_9$, $X_{10}$, $X_{11}$, $X_{12}$, or $X_{13}$ is a $\beta^3$-amino acid residue, and wherein $X_1$=T; $X_2$=D; $X_5$=R or K; $X_6$=M or L; $X_8$=A or V; $X_9$=R or K; $X_{10}$=R or K; $X_{11}$=S or A; $X_{12}$=L or K; and $X_{13}$=N or K. In some embodiments, at least one of the $\beta^3$-amino acid residues is substituted with a residue chosen from the following: (S,S)-trans-2-aminocyclopentanecarboxylic acid ((S,S)-ACPC), (S,R)-trans-2-aminocyclopentanecarboxylic acid ((S,R)-ACPC), (R,S)-trans-2-aminocyclopentanecarboxylic acid ((R,S)-ACPC), or (R,R)-trans-2-aminocyclopentanecarboxylic acid ((R,R)-ACPC) if the amino acid is non-polar; or pyrrolidine analogue of (S,S)-ACPC, (R,S)-ACPC, (S,R)-ACPC, (R,R)-ACPC), which is designated APC, if the amino acid is basic. In some embodiments, at least one of the $\beta^3$-amino acid residues is substituted with a residue chosen from the following: (S,S)-trans-2-aminocyclopentanecarboxylic acid ((S,S)-ACPC) if the amino acid is non-polar; or pyrrolidine analogue of (S,S)-ACPC if the residue is basic.

In some embodiments, the VIP analog of the claimed invention comprises the following sequence:

$X_1$T $X_2$LR $X_3$QI$X_4$AX$_5$ $X_6$YLQS I $X_7X_8$; (SEQ ID NO: 1364)

wherein $X_1$, $X_2$, $X_3$, $X_4$, $X_5$, $X_6$, $X_7$, $X_8$ are non-natural amino acids and wherein the underlined residues are β-amino acid residues. In some embodiments, the VIP analog of the claimed invention comprises the following sequence:

$X_1$T $X_2$LR $X_3$QI$X_4$AX$_5$ $X_6$YLQS I $X_7X_8$; (SEQ ID NO: 1364)

wherein $X_1$, $X_2$, $X_3$, $X_4$, $X_5$, $X_6$, $X_7$, $X_8$ are non-natural amino acids and wherein the underlined residues are $\beta^3$-amino acid residues. In some embodiments, at least one of the $\beta^3$-amino acid residues is substituted with a residue chosen from the following: (S,S)-trans-2-aminocyclopentanecarboxylic acid ((S,S)-ACPC), (S,R)-trans-2-aminocyclopentanecarboxylic acid ((S,R)-ACPC), (R,S)-trans-2-aminocyclopentanecarboxylic acid ((R,S)-ACPC), or (R,R)-trans-2-aminocyclopentanecarboxylic acid ((R,R)-ACPC) if the amino acid is non-polar; or pyrrolidine analogue of (S,S)-ACPC, (R,S)-ACPC, (S,R)-ACPC, (R,R)-ACPC), which is designated APC, if the amino acid is basic. In some embodiments, at least one of the $\beta^3$-amino acid residues is substituted with a residue chosen from the following: (S,S)-trans-2-aminocyclopentanecarboxylic acid ((S,S)-ACPC) if the amino acid is non-polar; or pyrrolidine analogue of (S,S)-ACPC if the residue is basic.

In some embodiments, the VIP analog of the claimed invention comprises the following sequence:

(SEQ ID NO: 1365)
Y(OMe)TOrnLRAib QLUAAib OrnYLQS IOrnOrn, wherein Orn=ornithine, Y(OMe)=O-methylated Tyrosine, Aib=α-aminoisobutyric acid, U=amino butyric acid (i.e., side chain=ethyl), and wherein each underlined position is a β-amino acid residue. In some embodiments at least one of the β-amino acid residue are $\beta^3$-amino acid residues. In some embodiments, at least one of the $\beta^3$-amino acid residues is substituted with a residue chosen from the following: (S,S)-trans-2-aminocyclopentanecarboxylic acid ((S,S)-ACPC), (S,R)-trans-2-aminocyclopentanecarboxylic acid ((S,R)-ACPC), (R,S)-trans-2-aminocyclopentanecarboxylic acid ((R,S)-ACPC), or (R,R)-trans-2-aminocyclopentanecarboxylic acid ((R,R)-ACPC) if the amino acid is non-polar; or pyrrolidine analogue of (S,S)-ACPC, (R,S)-ACPC, (S,R)-ACPC, (R,R)-ACPC), which is designated APC, if the amino acid is basic. In some embodiments, at least one of the $\beta^3$-amino acid residues is substituted with a residue chosen from the following: (S,S)-trans-2-aminocyclopentanecarboxylic acid ((S,S)-ACPC) if the amino acid is non-polar; or pyrrolidine analogue of (S,S)-ACPC if the residue is basic.

In some embodiments, the VIP analog of the claimed invention comprises at least 17% β-amino acid residues. In some embodiments, the VIP analog of the claimed invention comprises from about 15% to about 30% β-amino acid residues. In some embodiments, the VIP analog of the claimed invention comprises from about 15% to about 30% β-amino acid residues wherein the first ten amino acids of the amino acid sequence are alpha amino acids. In some embodiments, the VIP analog of the claimed invention comprises from about 16% to about 29% β-amino acid residues. In some embodiments, the VIP analog of the claimed invention comprises from about 17% to about 29% β-amino acid residues. In some embodiments, the VIP analog of the claimed invention comprises from about 18% to about 29% β-amino acid residues. In some embodiments, the VIP analog of the claimed invention comprises from about 19% to about 29% β-amino acid residues. In some embodiments, the VIP analog of the claimed invention comprises from about 20% to about 29% β-amino acid residues.

In some embodiments, the VIP analog of the claimed invention comprises β-amino acid residues at residue positions 11, 14, 18, 21, and 25 of HSDAVFTDNYTRLRKQ-MAVKKYLNSILN (SEQ ID NO: 10). In some embodiments, the VIP analog of the claimed invention comprises β-amino acid residues at positions 11, 14, 18, 21, and 25 of HSDAVFTDNYTRLRKQMAVKKYLNSILN (SEQ ID NO: 10), wherein the position 11 is $\beta^3$-homothreonine, position 14 is $\beta^3$-homoarginine, position 18 is $\beta^3$-homoalanine, position 21 is $\beta^3$-homolysine, and position 25 is $\beta^3$-homoserine. In some embodiments, at least one of the $\beta^3$-amino acid residues is substituted with a residue chosen from the following: (S,S)-trans-2-aminocyclopentanecarboxylic acid ((S,S)-ACPC), (S,R)-trans-2-aminocyclopentanecarboxylic acid ((S,R)-ACPC), (R,S)-trans-2-aminocyclopentanecarboxylic acid ((R,S)-ACPC), or (R,R)-trans-2-aminocyclopentanecarboxylic acid ((R,R)-ACPC) if the amino acid is non-polar; or pyrrolidine analogue of (S,S)-ACPC, (R,S)-ACPC, (S,R)-ACPC, (R,R)-ACPC), which is designated APC, if the amino acid is basic. In some embodiments, at least one of the β³-amino acid residues is substituted with a residue chosen from the following: (S,S)-trans-2-aminocyclopentanecarboxylic acid ((S,S)-ACPC) if the amino acid is non-polar; or pyrrolidine analogue of (S,S)-ACPC if the residue is basic.

In some embodiments, the VIP analog of the claimed invention comprises the following sequence:

(SEQ ID NO: 1352)
HSDAVFTDNY X₁RL X₂KQL X₃VK X₄YLN X₅ILN wherein X₁, X₂, X₃, X₄, and X₅ are β-amino acid residues and wherein all other α-amino residues are naturally-occurring or non-naturally occurring amino acid residues. In some embodiments, the VIP analog comprises a cyclic amino acid residue covalently bonded to one or more contiguous or non-contiguous amino acid sidechain residues via a lactam ring. In some embodiments, the VIP analog comprises a cyclic amino acid residue covalently bonded to one or more contiguous or non-contiguous amino acid sidechain residues via an amide bond. In some embodiments, the VIP analog of the claimed invention comprises one of the following sequences:

```
HSDAV FTDNY ARLRK QMAVK KALNS ILA    (SEQ ID NO: 435)
HSDAV FTDNY ARLRK QMAVK KALNS ILA    (SEQ ID NO: 435)
HSDAV FTDNY ARLRK QMAVK KALNS ILA    (SEQ ID NO: 435)
HSDAV FTDNY ARLRK QMAVK KALNS ILA    (SEQ ID NO: 435)
HSDAV FTDNY ARLRKQ MAVK KALNS ILA    (SEQ ID NO: 435)
HSDAV FTDNY ARLRKQ MAVK KALNS ILA    (SEQ ID NO: 435)
HSDAV FTDNY ARLRKQ MAVK KALNS ILA    (SEQ ID NO: 435)
HADAV FTAAY ARLRK QMAAK KALAA IAA    (SEQ ID NO: 434)
HADAV FTAAY ARLRK QMAAK KALAA IAA    (SEQ ID NO: 434)
HADAV FTAAY ARLRK QMAAK KALAA IAA    (SEQ ID NO: 434)
HADAV FTAAY ARLRK QMAAK KALAA IAA    (SEQ ID NO: 434)
HADAV FTAAY ARLRKQ MAAK KALAA IAA    (SEQ ID NO: 434)
HADAV FTAAY ARLRKQ MAAK KALAA IAA    (SEQ ID NO: 434)
HADAV FTAAY ARLRKQ MAAK KALAA IAA    (SEQ ID NO: 434)
``` wherein each underlined residue is: a β³-homoamino acid residue; or, if a non-polar (e.g., A, V), the underlined residues is/are (S,S)-trans-2-aminocyclopentanecarboxylic acid ((S,S)-ACPC); or, if the underlined position is basic, (such as Lys or Arg), the underlined residue is a pyrrolidine analogue of (S,S)-ACPC, which is designated APC. (Note: Ac=acetyl; N$^{le}$=norleucine; K*---D* indicates that the side chains of these two residues are linked via an amide bond.) In some embodiments, the sidechains of K and D are not linked via any bond.

a/b-Peptide analogues will be synthesized:

```
                                     (SEQ ID NO: 1373)
Ac-HSDAV FTENY TKLRK QAVK K*YLND* LKKGG T (SEQ ID NO: 1373)
Ac-HSDAV FTENY TKLRK QNleAVK K*YLND* LKKGG T (SEQ ID NO: 1373)
Ac-HSDAV FTENY TKLRK QNleAVK K*YLND* LKKGG T (SEQ ID NO: 1373)
Ac-HSDAV FTENY TKLRK QNleAVK K*YLND* LKKGG T (SEQ ID NO: 1373)
Ac-HSDAV FTENY TKLRK QNleAVK K*YLND* LKKGG T (SEQ ID NO: 1373)
Ac-HSDAV FTENY TKLRK QNleAVK K*YLND* LKKGG T (SEQ ID NO: 1373)
Ac-HSDAV FTENY TKLRK QNleAVK K*YLND* LKKGG T (SEQ ID NO: 1374)
Ac-HSDAV FTENY TKLRK RNleAAK NleYLNN LKKGG T (SEQ ID NO: 1374)
Ac-HSDAV FTENY TKLRK RNleAAK NleYLNN LKKGG T (SEQ ID NO: 1374)
Ac-HSDAV FTENY TKLRK RNleAAK NleYLNN LKKGG T (SEQ ID NO: 1374)
Ac-HSDAV FTENY TKLRK RNleAAK NleYLNN LKKGG T (SEQ ID NO: 1374)
Ac-HSDAV FTENY TKLRK RNleAAK NleYLNN LKKGG T (SEQ ID NO: 1374)
Ac-HSDAV FTENY TKLRK RNleAAK NleYLNN LKKGG T (SEQ ID NO: 1374)
Ac-HSDAV FTENY TKLRK RNleAAK NleYLNN LKKGG T
``` wherein each underlined residue is: a β³-homoamino acid residue; or, if a non-polar (e.g., A, V), the underlined positions will be replaced by (S,S)-trans-2-aminocyclopentanecarboxylic acid ((S,S)-ACPC); or if the underlined residue is basic, (such as Lys or Arg), the underlined residue is/are the pyrrolidine analogue of (S,S)-ACPC, which is designated APC; and wherein Ac=acetyl; N$^{le}$=norleucine; K*---D* indicates that the side chains of these two residues are linked via an amide bond. In some embodiments, the sidechains of K and D are not linked via any bond. In some embodiments, the VIP analog comprises a cyclic amino acid residue covalently bonded to one or more contiguous or non-contiguous amino acid sidechain residues via the following synthetic linking structures:

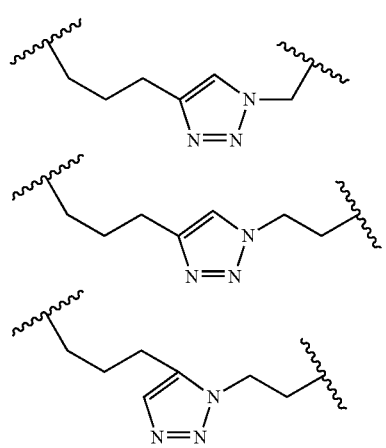

125
-continued
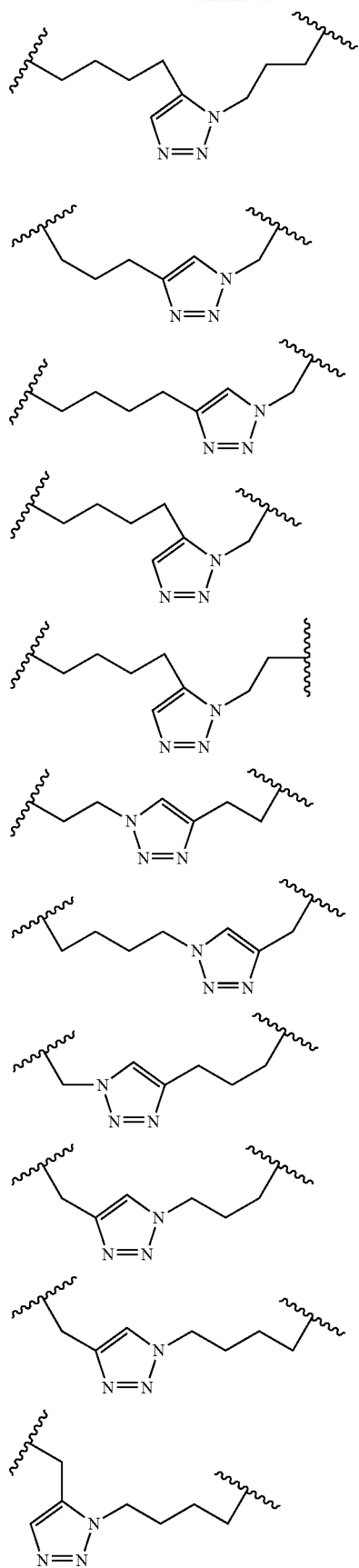
126
-continued
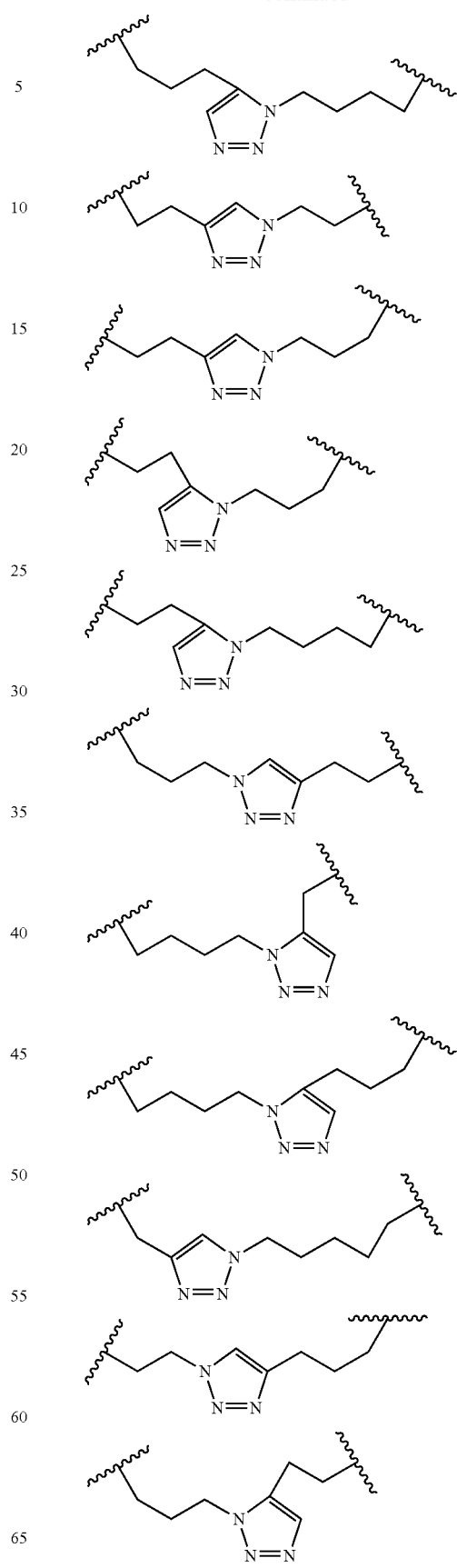

127
-continued
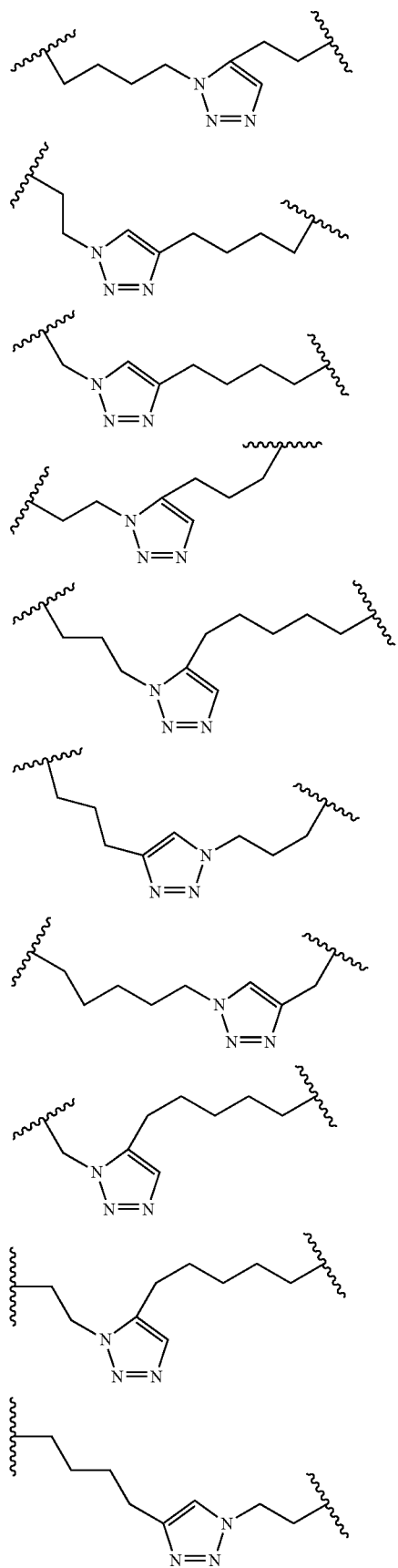
128
-continued
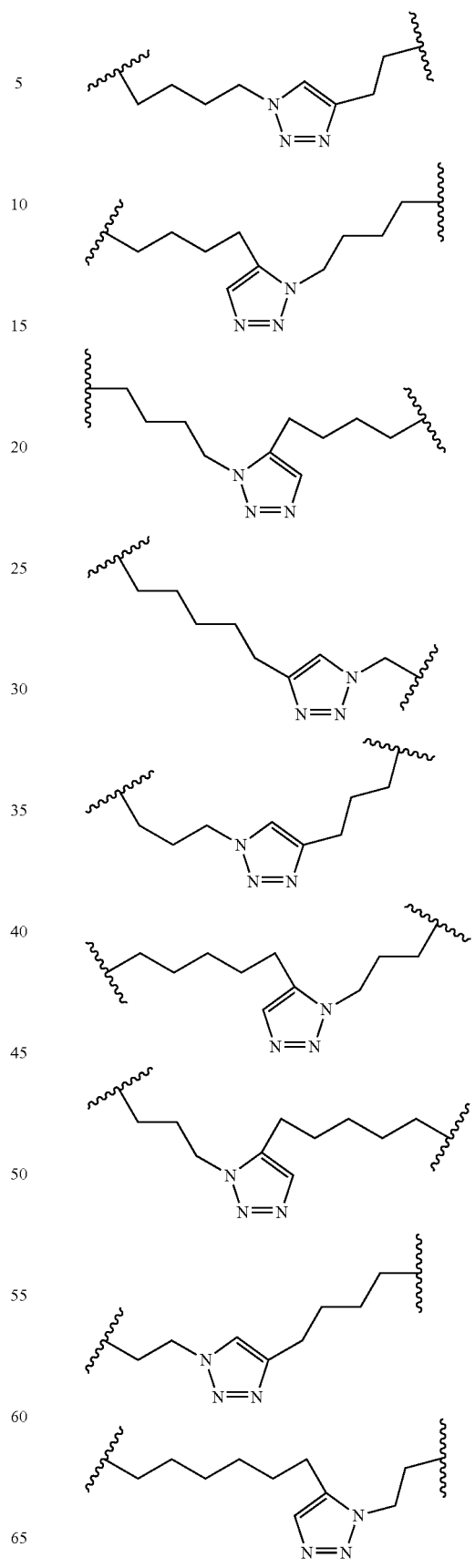

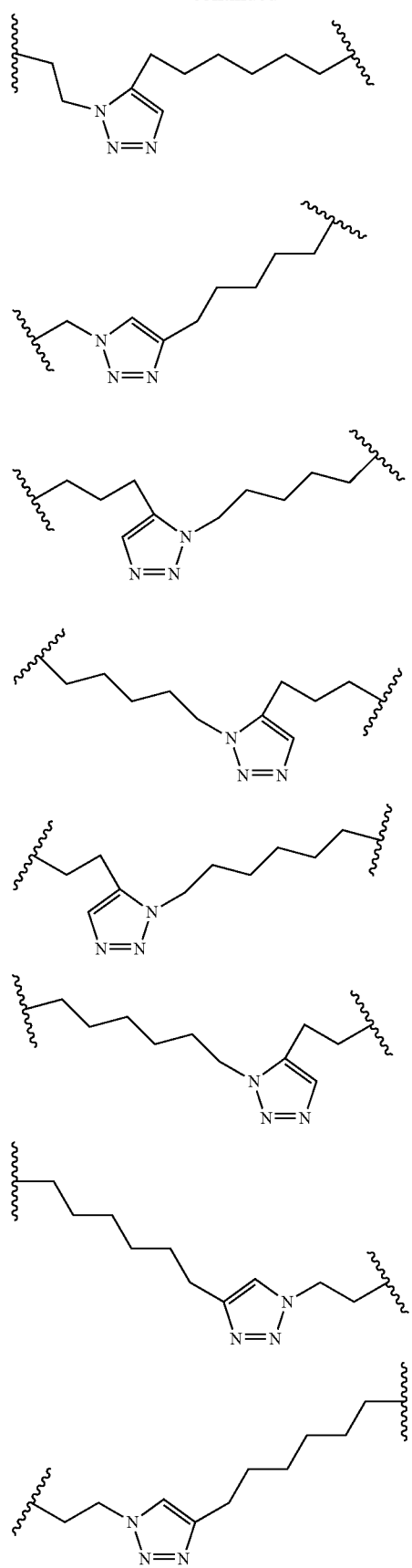
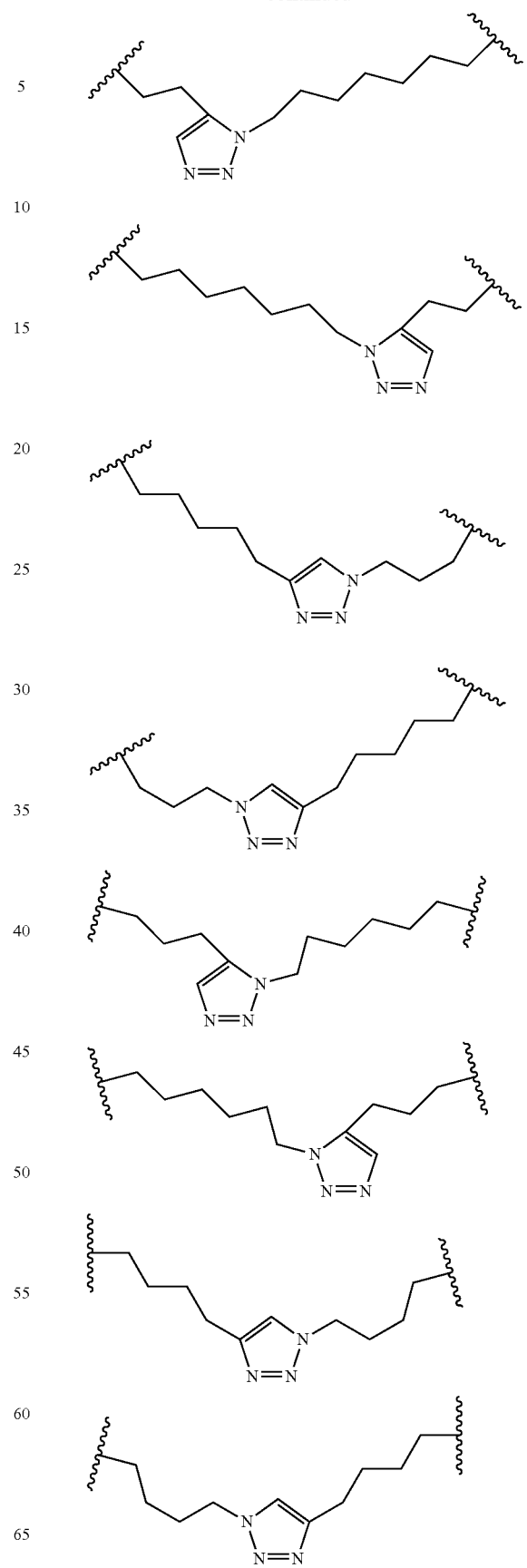

131
-continued
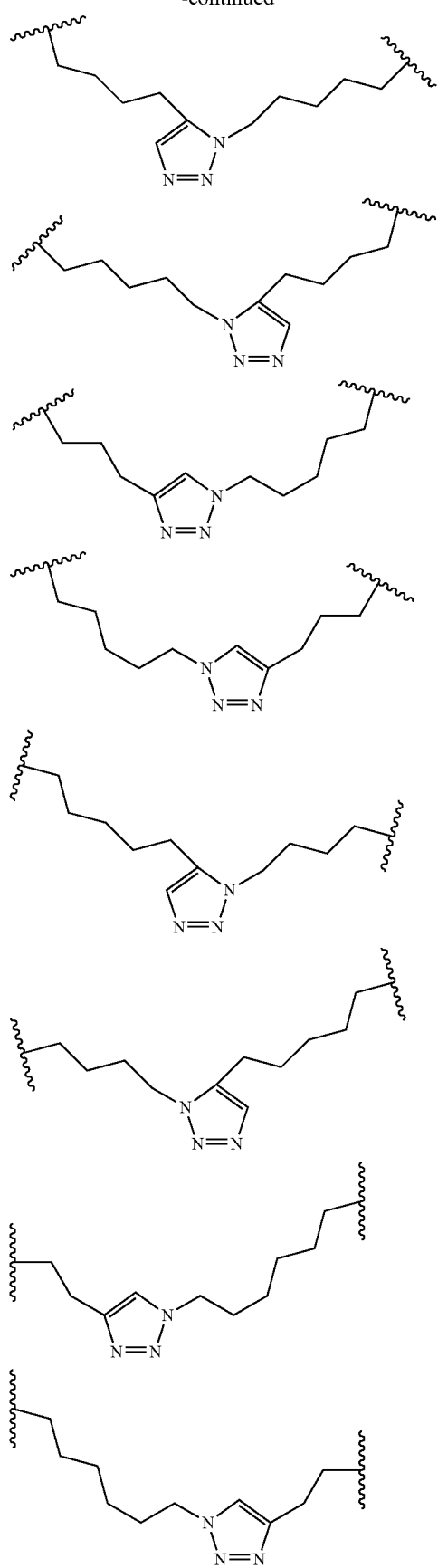
132
-continued
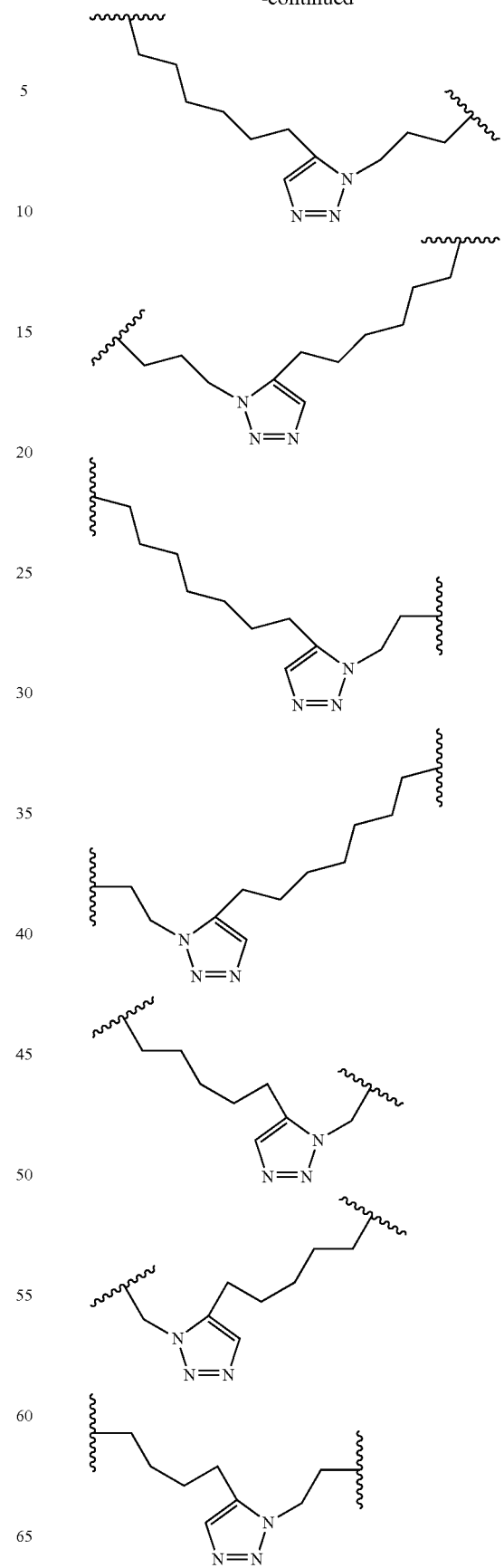

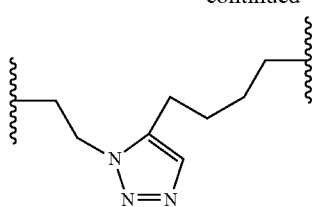
In some embodiments, the analog does not comprise a cyclic substituent in its side chain. In some embodiments, the cyclic amino acid residues are not covalently bonded to one or more contiguous or non-contiguous amino acid sidechain residues via the following synthetic linking structures:
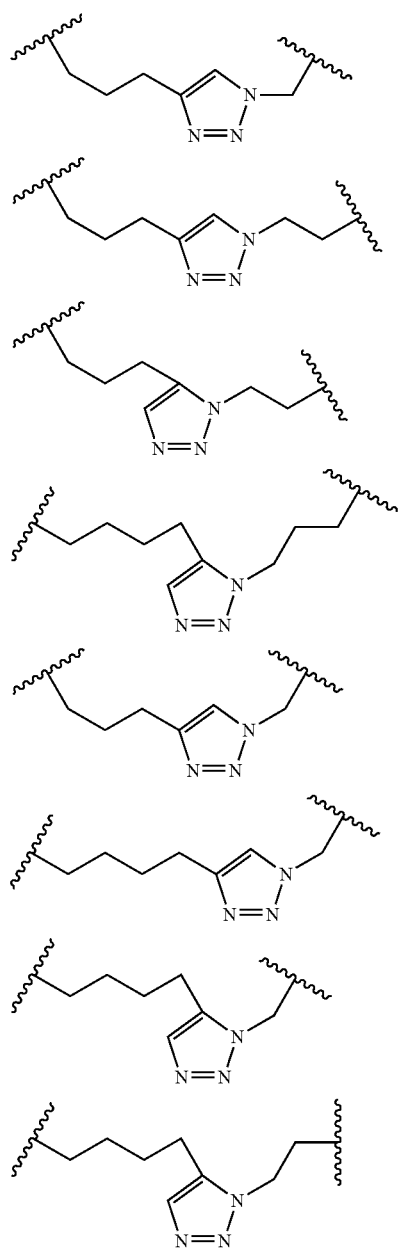
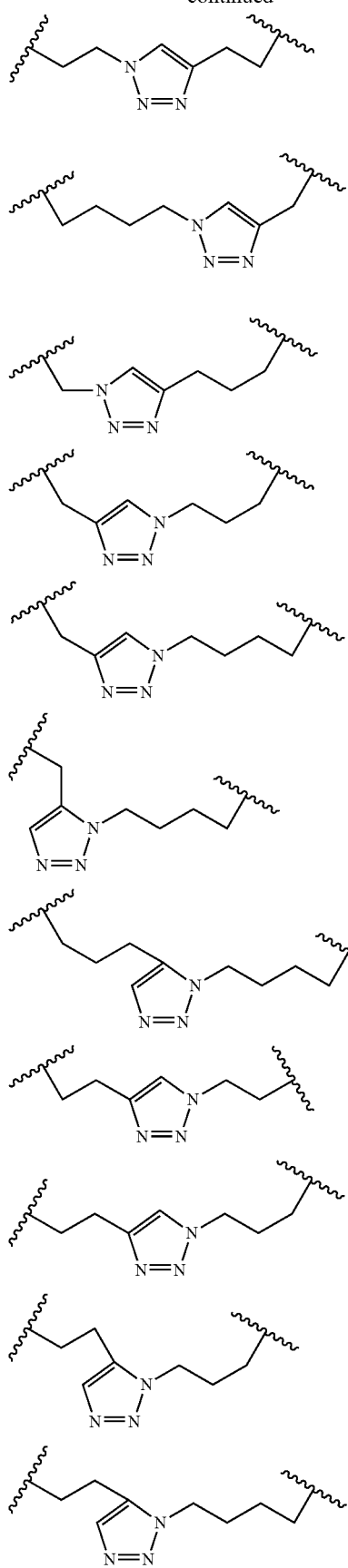

135
-continued
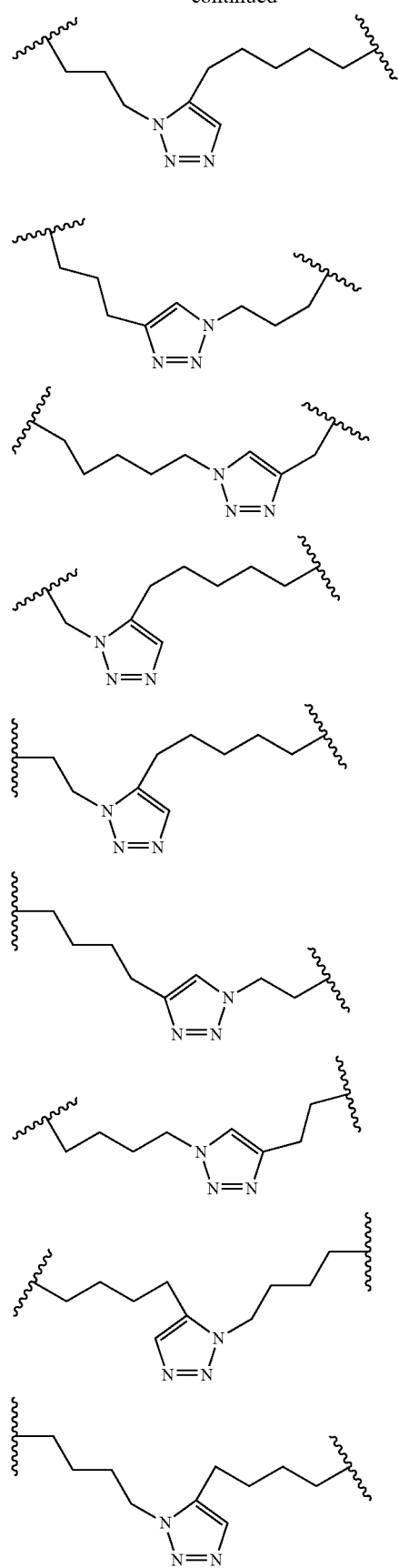
136
-continued
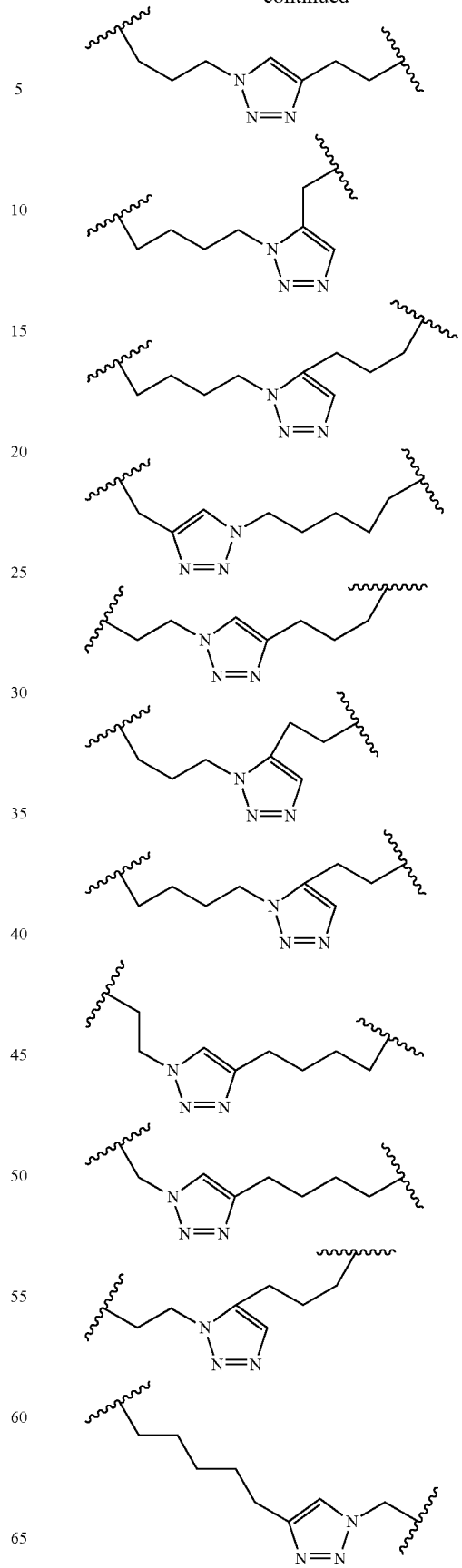

137
-continued
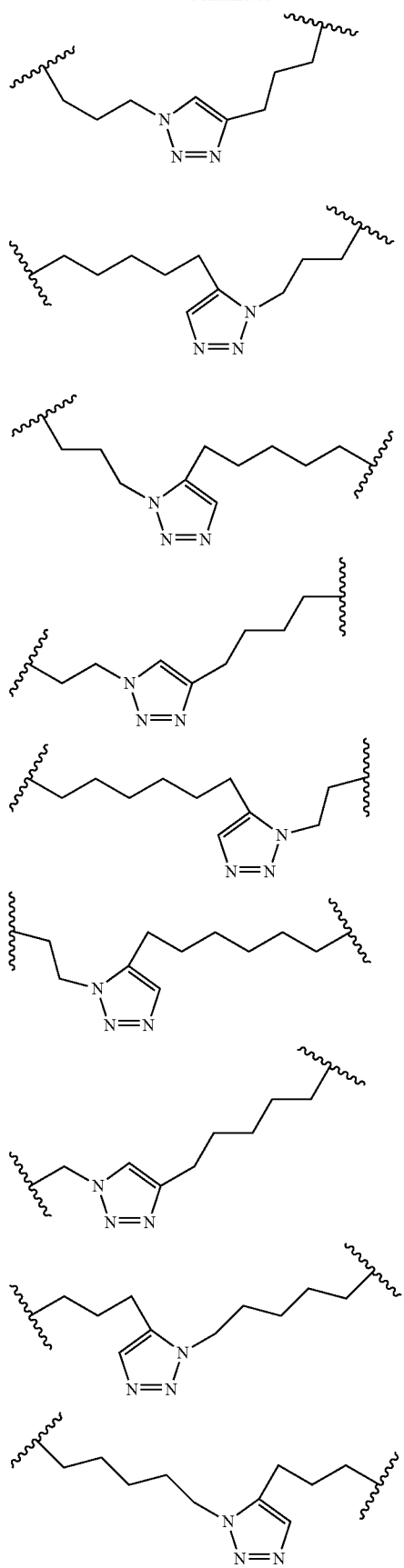
138
-continued
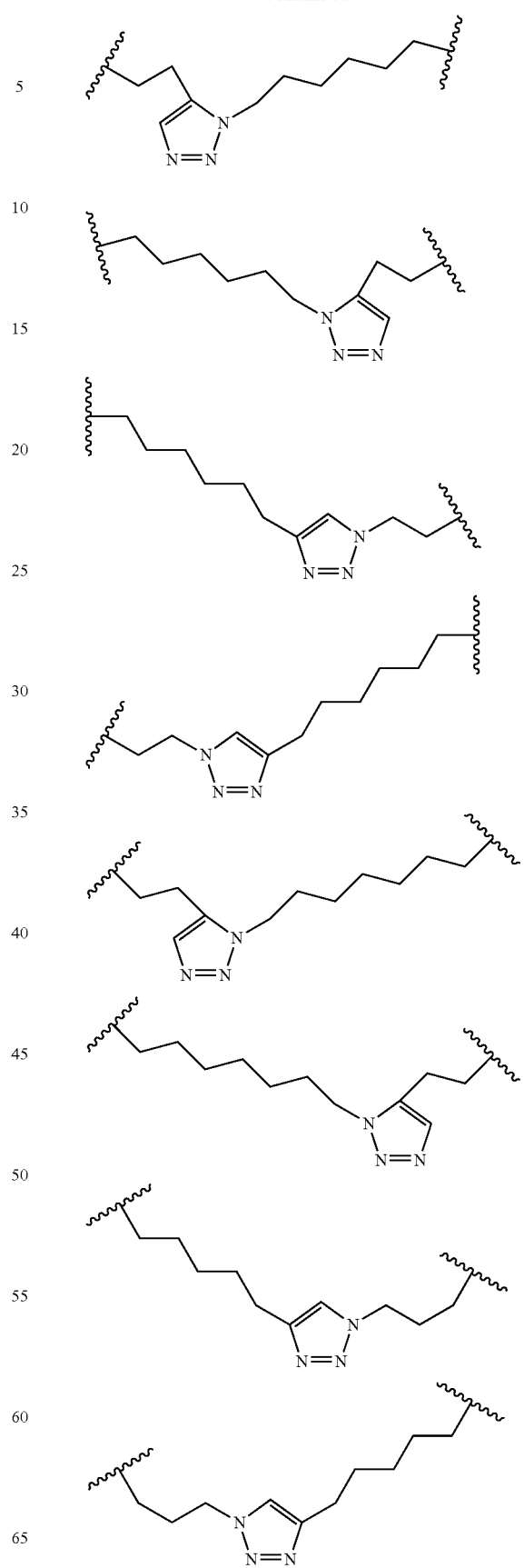

139
-continued
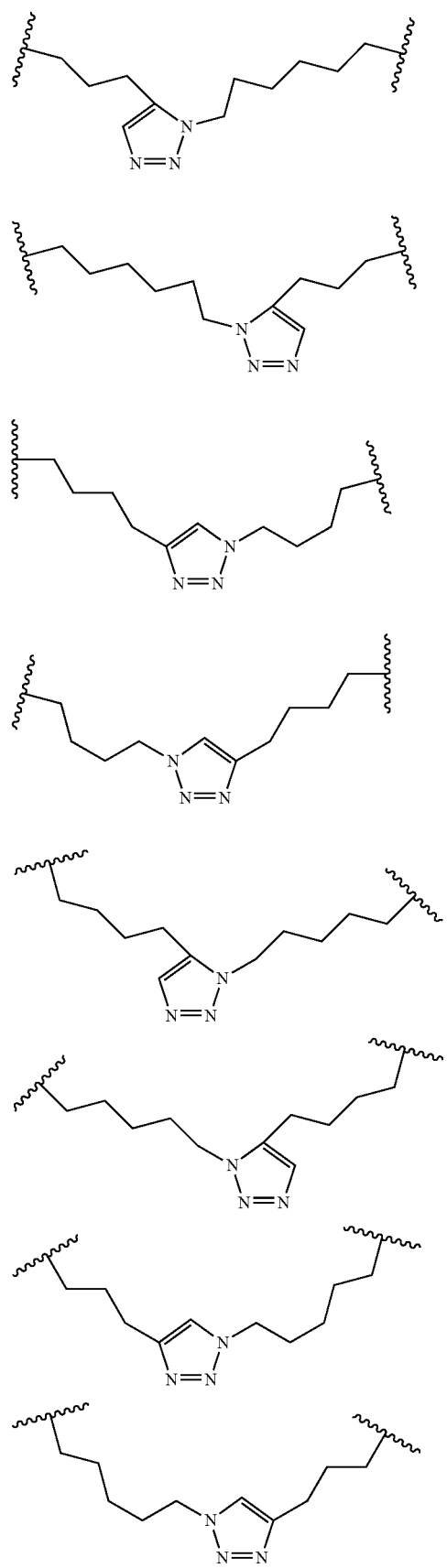
140
-continued
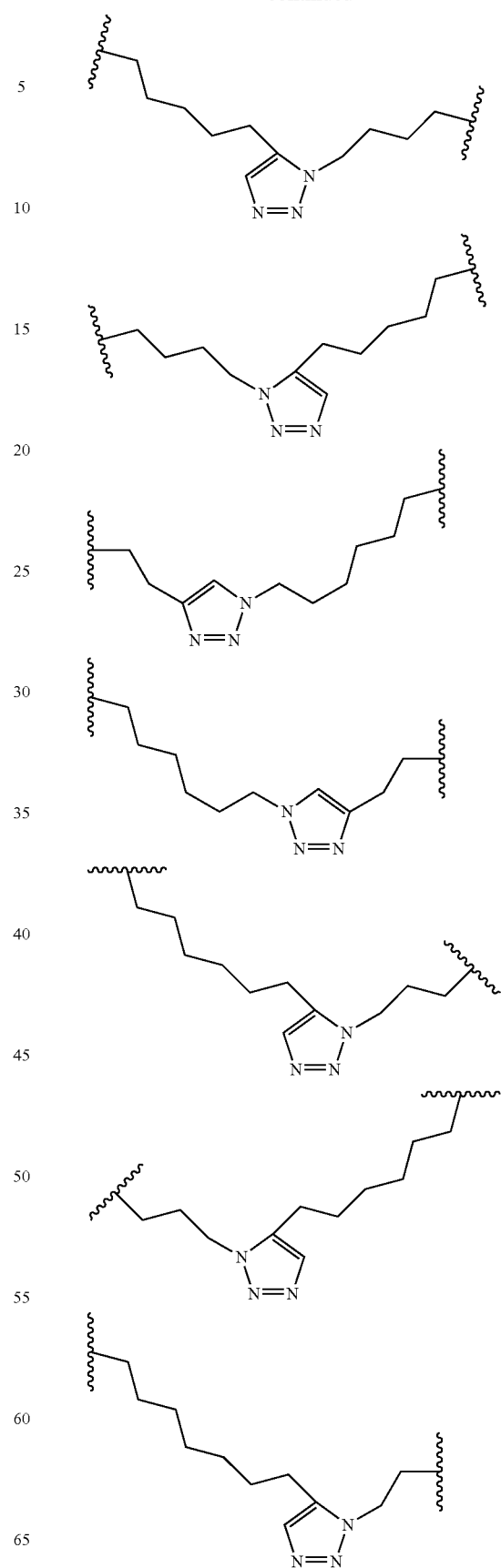

-continued

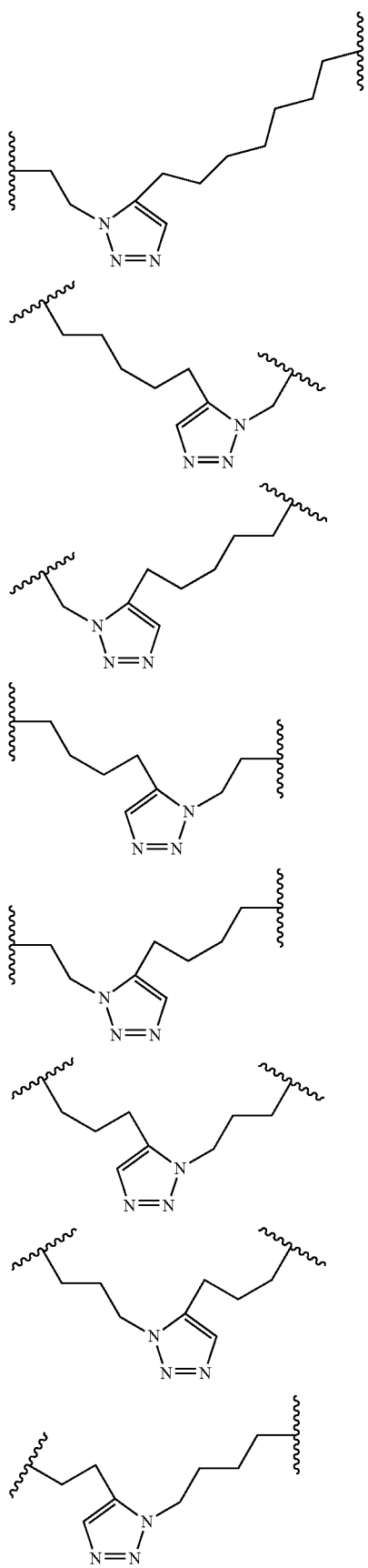

-continued

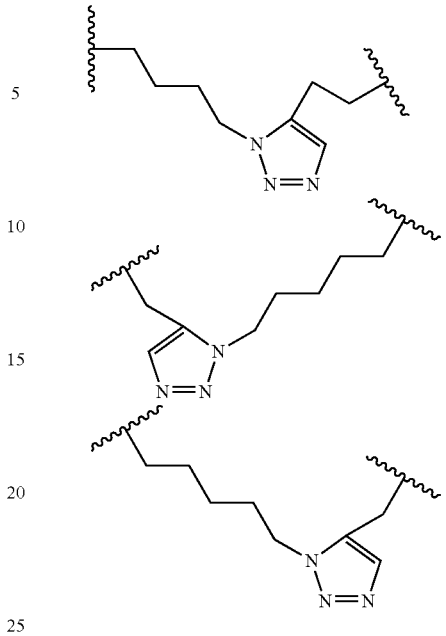

In some embodiments, the analogs of the present invention comprise at least one or a plurality of the following cyclic amino acid residues, some of which being described with a protecting group that becomes eliminated from the analog either during synthesis or when the analog is purified after synthesis:

L-β-HomohydroxyProline hydrochloride
(1R,2R)-Boc-2-aminocyclohexane carboxylic acid {(1R,2R)-ACHC}
(1R,2R)-Fmoc-2-aminocyclohexane carboxylic acid {(1R,2R)-ACHC}
(1R,2S)-Boc-2-aminocyclohexane carboxylic acid {(1R,2S)-ACHC}
(1R,2S)-Fmoc-2-aminocyclohexane carboxylic acid {(1R,2S)-ACHC}
(1S,2R)-Boc-2-aminocyclohexane carboxylic acid {(1S,2R)-ACHC}
(1S,2R)-Fmoc-2-aminocyclohexane carboxylic acid (1S,2R)-ACHC}
(1S,2S)-Boc-2-aminocyclohexane carboxylic acid {(1S,2S)-ACHC}
(1S,2S)-Fmoc-2-aminocyclohexane carboxylic acid {(1S,2S)-ACHC}
(1R,2R)-Boc-2-aminocyclopentane carboxylic acid {(1R,2R)-ACPC}
(1R,2R)-Fmoc-2-aminocyclopentane carboxylic acid {(1R,2R)-ACPC}
(1S,2S)-Boc-2-aminocyclopentane carboxylic acid {(1S,2S)-ACPC}
(1S,2S)-Fmoc-2-aminocyclopentane carboxylic acid {(1S,2S)-ACPC}
Boc-cis-2-aminocyclopentane carboxylic acid, cis-Acpc
Fmoc-cis-2-aminocyclopentane carboxylic acid, cis-Acpc
(R)-Boc-(2-carboxymethyl)-piperidine, (R)-(1-piperidin-2-yl)-acetic acid
(R)-Fmoc-(2-carboxymethyl)-piperidine, (R)-(1-Fmoc-piperidin-2-yl)-acetic acid
(S)-Boc-(2-carboxymethyl)-piperidine (S)-(1-Boc-piperidin-2-yl)-acetic acid
(S)-Fmoc-(2-carboxymethyl)-piperidine (S)-(1-Fmoc-piperidin-2-yl)-acetic acid (R,S)-Boc-2-carboxymorpholine Boc-Cop
(R,S)-Boc-2-carboxymorpholine Fmoc-Cop
(R,S)-Boc-nipecotic acid Boc-Nip
(R,S)-Boc-nipecotic acid Fmoc-Nip
(R)-Fmoc-nipecotic acid (R)-Fmoc-Nip
(R)-Fmoc-nipecotic acid (R)-Boc-Nip
(3S)-Boc-1-pyrrolidine-3-carboxylic acid (3S)-Boc-beta-Pro-OH
(3S)-Fmoc-1-pyrrolidine-3-carboxylic acid (3S)-Fmoc-beta-Pro-OH In some embodiments, the analogs of the present invention comprise at least one or a plurality of non-natural amino acid residues that can modified by PEGylation. In some embodiments the analogs or fragments of the polypeptides related to this invention comprise PEG molecules which are covalently bound to the side chain of the α, or β amino acids in the polypeptide. In some embodiments, the polypeptides of this invention comprise the PEGylated cyclic amino acid residues or cyclic amino acid side chains. PEG molecule(s) may be covalently attached to any Lys, Cys, K(W) or K(CO(CH$_2$)$_2$SH) residue at any position in the analog or fragment of analog. In some embodiments, the analog or a fragment thereof comprises a C-terminal extension may comprise one or more Cys residues which may be PEGylated. In some embodiment of the invention the polypeptides or fragments thereof may comprise one or more PEGylated residues in either or both sequences.

In some embodiments, the analog or fragment thereof comprises a PEG molecule covalently attached to one or all of the β-residue within the analog. In some embodiments, the analog is at least one PEG molecule covalently attached to a residue in the C-terminal extension of the analog or fragment thereof. In some embodiments, the analog comprises more than one PEG molecule, there may be a combination of Lys, Cys, K(CO(CH$_2$)$_2$SH), K(W) and carboxy-terminal amino acid PEGylation. For example, if there are two PEG molecules, one may be attached to a Lys residue and one may be attached to a Cys residue. In some embodiments, the polypeptide comprises one or more covalently bound PEG molecules, wherein at least one of the PEG molecules is branched. In some embodiments, one or more of the PEG molecules are linear. In some embodiments, the composition comprises one or more PEG molecule, wherein the PEG molecule is between about 200 daltons and about 100,000 daltons in molecular weight. In some embodiments, the PEG molecule is chosen from 10,000, 20,000, 30,000, 40,000, 50,000 and 60,000 daltons. In some embodiments, it is chosen from 20,000, 30,000, 40,000, or 60,000 daltons. Where there are two PEG molecules covalently attached to the analog or fragment thereof, each is 1,000 to 40,000 daltons and, they have molecular weights of 20,000 and 20,000 daltons, 10,000 and 30,000 daltons, 30,000 and 30,000 daltons, or 20,000 and 40,000 daltons. In some embodiments mini-PEG s™ are covalently bound to at least one residue or side chain of an a, or β-amino acid. In some embodiments, the mini-PEG™ is chosen from the following list of products: 8-Amino-3,6-Dioxaoctanoic Acid, 11-Amino-3,6,9-Trioxaundecanoic Acid, 8-Amino-3,6-Dioxaoctanoic Acid.DCHA, 11-Amino-3,6,9-Trioxaundecanoic Acid.DCHA.

In some embodiments the method of treatment or prevention of a human disorder depends upon the analog being synthesized. For instance: Peptides for triggering B and T cell activity can be used to treat autoimmune disease, including uveitis, collagen-induced, adjuvant and rheumatoid arthritis, thyroiditis, myasthenia gravis, multiple sclerosis and diabetes. Examples of these peptides are interleukins (referenced in Aulitzky, WE; Schuler, M; Peschel, C.; Huber, C.; Interleukins. Clinical pharmacology and therapeutic use. Drugs. 48(5):667-77, November 1994) and cytokines (referenced in Peters, M.; Actions of cytokines on the immune response and viral interactions: an overview. Hepatology. 23(4):909-16, April 1996).

Enkephlin analogs, agonist analogs and antagonist analogs can be used to treat AIDS, ARC, and cancer, pain modulation, Huntington's, Parkinson's diseases.

LHRH and analogs, agonists and antagonists can be used to treat prostatic tumors and reproductive physiopathology, including breast cancer, and infertility.

Peptides and peptidomimetics that target crucial enzymes, oncogenes or oncogene products, tumor-suppressor genes and their products, growth factors and their corresponding receptors can be used to treat cancer. Examples of these peptides are described in Unger, C. Current concepts of treatment in medical oncology: new anticancer drugs. Journal of Cancer Research & Clinical Oncology. 122(4):189-98, 1996.

Neuropeptide Y and other pancreatic polypeptides, and analogs, agonists and antagonists can be used to treat stress, anxiety, neurodegenative diseases, depression and associated vasoconstrictive activities.

Gluco-incretins, including gastric inhibitory polypeptide, glucose-dependent insulinotropic polypeptide, PACAP/Glucagon and glucagon-like polypeptide-1 and 2 and analogs, agonists and antagonists can be used to treat Type II diabetic hyperglycaemia. Atrial natriuretic factor and analogs, agonists and antagonists can be used to treat congestive heart failure.

Integrin and analogs, agonists and antagonists can be used to treat osteoporosis, scar formation, bone synthesis, inhibition of vascular occlusion, and inhibition of tumor invasion and metastasis.

Glucagon, glucagon-like peptide 1, PACAP/Glucagon, and analogs, agonists and antagonists can be used to treat diabetes cardiovascular emergencies.

Antithrombotic peptides and analogs, agonists and antagonists can be used to treat cardiovascular and cerebrovascular diseases. Examples of these peptides RGD, D-Phe-Pro-Arg and others named are described in Ojima I.; Chakravarty S.; Dong Q. Antithrombotic agents: from RGD to peptide mimetics. Bioorganic & Medicinal Chemistry. 3(4):337-60, 1995.

Cytokines/interleukins and analogs, agonists and antagonists can be used to treat inflammatory disease, immune response dysfunction, hematopoiesis, mycosis fungoides, aplastic anemia, thrombocytopenia, and malignant melanoma. Examples of these peptides are Interleukins, referenced in Aulitzky et al. and Peters et al., which is herein incorporated by reference.

Endothelin and analogs, agonists and antagonists can be used to treat arterial hypertension, myocardial infarction, congestive heart failure, atherosclerosis, shock conditions, renal failure, asthma and vasospasm Natriuretic hormones and analogs, agonists and antagonists can be used to treat cardiovasicular disease and acute renal failure. Examples of these peptides are named and described in Espiner, E. A; Richards, A. M.; Yandle, T. G.; Nicholls, M. G.; Natriuretic hormones. Endocrinology & Metabolism Clinics of North America. 24(3):481-509, 1995.

Peptides that activate or inhibit tyrosine kinase, or bind to TK-activating or inhibiting peptides and analogs, agonists and antagonists can be used to treat chronic myelogenous and acute lymphocytic leukemias, breast and ovarian cancers and other tyrosine kinase associated diseases. Examples of these peptides are described in Smithgall, T E.; SH2 and SH3 domains: potential targets for anti-cancer drug design. Journal of Pharmacological & Toxicological Methods. 34(3):125-32, 1995.

Renin inhibitors analogs, agonists and antagonists can be used to treat cardiovascular disease, including hypertension and congestive heart failure. Examples of these peptides are described in Rosenberg, S. H.; Renin inhibition. Cardiovascular Drugs & Therapy. 9(5):645-55, 1995.

Angiotensin-converting enzyme inhibitors, analogs, agonists and antagonists can be used to treat cardiovascular disease, including hypertension and congestive heart failure. Peptides that activate or inhibit tyrosine phosphorylases can be used to treat cardiovascular diseases. Examples of these peptides are described in Srivastava, A. K.; Protein tyrosine phosphorylation in cardiovascular system. Molecular & Cellular Biochemistry. 149-150:87-94, 1995.

Peptide based antivirals can be used to treat viral diseases. Examples of these peptides are described in Toes, R. E.; Feltkamp, M. C.; Ressing, M. E.; Vierboom, M. P.; Blom, R. J.; Brandt, R. M; Hartman, M.; Offringa, R.; Melief, C. J.; Kast, W. M.; Cellular immunity against DNA tumour viruses: possibilities for peptide-based vaccines and immune escape. Biochemical Society Transactions. 23(3):692-6, 1995.

Corticotropin releasing factor and peptide analogs, agonist analogs and antagonist analogs can be used to treat disease associated with high CRF, i.e Alzheimer's disease, anorexia nervosa, depressive disorders, arthritis, and multiple sclerosis.

Peptide agonist analogs and antagonist analogs of platelet-derived wound-healing formula (PDWHF) can be used as a therapy for donor tissue limitations and wound-healing constraints in surgery. Examples of these peptides are described in Rudkin, G. H.; Miller, T. A.; Growth factors in surgery. Plastic & Reconstructive Surgery. 97(2):469-76, 1996. Fibronectin, fibrinopeptide inhibitors and analogs, agonists and antagonists can be used to treat metastasis (i.e. enzyme inhibition, tumor cell migration, invasion, and metastasis).

Chemokine (types of cytokine, including interleukin-8, RANTES, and monocyte chemotactic peptide) analogs, agonist analogs and antagonist analogs can be used to treat arthritis, hypersensitivity, angiogenesis, renal disease, glomerulonephritis, inflammation, and hematopoiesis.

Neutral endopeptidase inhibitors analogs, agonist analogs and antagonist analogs can be used to treat hypertension and inflammation. Examples of these peptides are described in Gregoire, J. R; Sheps, S. G; Newer antihypertensive drugs. Current Opinion in Cardiology. 10(5):445-9, 1995.

Substance P analogs, agonist analogs and antagonist analogs can be used to treat immune system dysfunction, pain transmission/perception and in autonomic reflexes and behaviors. Alpha-melanocyte-stimulating hormone analogs, agonist analogs and antagonist analogs can be used to treat AIDS, rheumatoid arthritis, and myocardial infarction.

Bradykinin (BK) analogs, agonist analogs and antagonist analogs can be used to treat inflammatory diseases (edema, etc), asthma, allergic reactions (rhinitis, etc), anesthetic uses, and septic shock.

Secretin analogs can be used to treat cardiovascular emergencies.

GnRH analogs, agonist analogs and antagonist analogs can be used to treat hormone-dependent breast and prostate tumors.

Somatostatin analogs, agonist analogs and antagonist analogs can be used to treat gut neuroendocrine tumors.

Gastrin, Gastrin Releasing Peptide analogs, agonist analogs and antagonist analogs can be used as an adjuvant to chemotherapy or surgery in small cell lung cancer and other malignancies, or to treat allergic respiratory diseases, asthma and allergic rhinitis.

Laminin analogs, agonist analogs and antagonist analogs, the Laminin derivative antimetastatic drug YIGSR analogs, Laminin-derived synthetic peptides analogs, agonist analogs and antagonist analogs can be used to treat tumor cell growth, angiogenesis, regeneration studies, vascularization of the eye with diabetes, and ischemia. The peptides of this category can inhibit the tumor growth and metastasis of leukemic cells and may be useful as a potential therapeutic reagent for leukaemic infiltrations. Peptides containing this sequence also inhibit experimental metastasis. Exemplary references include McGowan K A. Marinkovich M P. Laminins and human disease. Microscopy Research & Technique. 51(3):262-79, Nov. 1, 2000; Yoshida N. Ishii E. Nomizu M. Yamada Y. Mohri S. Kinukawa N. Matsuzaki A. Oshima K. Hara T. Miyazaki S. The laminin-derived peptide YIGSR (Tyr-Ile-Gly-Ser-Arg) inhibits human pre-B leukaemic cell growth and dissemination to organs in SCID mice. British Journal of Cancer. 80(12): 1898-904, 1999. Examples of these peptides are also described in Kleinman, H. K.; Weeks, B. S.; Schnaper, H. W.; Kibbey, M. C.; Yamamura, K.; Grant, D. S; The laminins: a family of basement membrane glycoproteins important in cell differentiation and tumor metastases. Vitamins & Hormones. 47:161-86, 1993.

Defensins, corticostatins, dermaseptins, mangainins, and other antibiotic (antibacterial and antimicrobial) peptides analogs, agonist analogs and antagonist analogs can be used to treat infections, tissue inflammation and endocrine regulation.

Vasopressin analogs, agonist analogs and antagonist analogs can be used to treat neurological disorders, stress and Diabetes insipidus.

Oxytocin analogs, agonist analogs and antagonist analogs can be used to treat neurological disorders and to induce labor.

ACTH-related peptides and analogs, agonist analogs and antagonist analogs can be used as neurotrophic, neuroprotective, and peripheral demyelinating neuropathy agents. Amyloid-beta peptide analogs, agonist analogs and antagonist analogs can be used to treat Alzheimer's disease.

Epidermal growth factor, receptor analogs, agonist analogs and antagonist analogs can be used to treat necrotizing enterocolitis, Zollinger-Ellison syndrome, gastrointestinal ulceration, colitis, and congenital microvillus atrophycarcinomas.

Leukocyte adhesion molecule analogs, agonist analogs and antagonist analogs can be used to treat atherosclerosis, inflammation. Examples of these peptides are described in Barker, J. N.; Adhesion molecules in cutaneous inflammation. Ciba Foundation Symposium. 189:91-101.

Major histocompatibility complex (MHC) analogs, agonist analogs and antagonist analogs can be used to treat autoimmune, immunodysfunctional, immuno modulatory diseases and as well as used for their corresponding therapies. Examples of these peptides are described in Appella, E.; Padlan, E. A.; Hunt, D. F; Analysis of the structure of naturally processed peptides bound by class I and class II major histocompatibility complex molecules. EXS. 73:105-19, 1995.

Corticotropin releasing factor analogs can be used to treat neurological disorders.

Neurotrophins (including brain-derived neurotrophic factor (BDNF), nerve growth factor, and neurotrophin 3) analogs, agonist analogs and antagonist analogs can be used to treat neurological disorders.

Cytotoxic T-cell activating peptide analogs, agonist analogs and antagonist analogs can be used to treat infectious diseases and cancer. Examples of these peptides are described in: Chesnut R. W.; Sette, A.; Celis, E.; Wentworth, P.; Kubo, R. T.; Alexander, J.; Ishioka, G.; Vitiello, A.; Grey, H. M; Design and testing of peptide-based cytotoxic T-cell-mediated immunotherapeutics to treat infectious diseases and cancer. Pharmaceutical Biotechnology. 6:847-74, 1995.

Peptide immunogens for prevention of HIV-1 and HTLV-I retroviral infections can be used to treat AIDS. Examples of these peptides are described in Hart, M. K.; Palker, T. J.; Haynes, B F; Design of experimental synthetic peptide immunogens for prevention of HIV-1 and HTLV-I retroviral infections. Pharmaceutical Biotechnology. 6:821-45, 1995.

Galanin analogs, agonist analogs and antagonist analogs can be used to treat Alzheimer's disease, depression, eating disorders, chronic pain, prevention of ischemic damage, and growth hormone modulation.

Tachykinins (neurokinin A and neurokinin B) analogs, agonist analogs and antagonist analogs can be used to treat pain transmission/perception and in autonomic reflexes and behaviors.

RGD containing peptide analogs can be used to treat various diseases involved with cell adhesion, antithrombotics, and acute renal failure.

Osteogenic growth peptide analogs, agonist analogs and antagonist analogs can be used as treatment of systemic bone loss. Examples of these peptides are described in Bab IA. Regulatory role of osteogenic growth peptide in proliferation, osteogenesis, and hemopoiesis. Clinical Orthopaedics & Related Research. (313):64-8, 1995.

Parathyroid hormone, parathyroid hormone related-peptide analogs, agonist analogs and antagonist analogs can be used to treat diseases affecting calcium homeostasis (hypercalcemia), bone metabolism, vascular disease, and atherosclerosis.

Kallidin analogs, agonist analogs and antagonist analogs can be used to treat tissue injury or inflammation and pain signaling pathological conditions of the CNS.

T cell receptor peptide analogs, agonist analogs and antagonist analogs can be used in immunotherapy. Examples of these peptides are described in Brostoff, S W; T cell receptor peptide vaccines as immunotherapy. Agents & Actions—Supplements. 47:53-8, 1995.

Platelet-derived growth factor (PDGF) analogs, agonist analogs and antagonist analogs can be used to treat nonneoplastic hyperproliferative disorders, therapy for donor tissue limitations and wound-healing constraints in surgery.

Amylin, calcitonin gene related peptides (CGRP) analogs, agonist analogs and antagonist analogs can be used to treat insulin-dependent diabetes.

VIP analogs, agonist analogs and antagonist analogs can be used to treat allergic respiratory diseases, asthma and allergic rhinitis, and nervous control of reproductive functions.

Growth hormone-releasing hormone (GHRH) analogs, agonist analogs and antagonist analogs can be used to treat growth hormone deficiency and immunomodulation.

HIV protease inhibiting peptide analogs, agonist analogs and antagonist analogs can be used to treat AIDS. Examples of these peptides are described in Bugelski, P. J.; Kirsh, R.; Hart, T. K; HIV protease inhibitors: effects on viral maturation and physiologic function in macrophages. Journal of Leukocyte Biology. 56(3):374-80, 1994.

Thymopoietin active fragment peptides analogs, agonist analogs and antagonist analogs can be used to treat rheumatoid arthritis and virus infections.

Cecropins analogs, agonist analogs and antagonist analogs can be used as antibacterials.

Thyroid releasing hormone (TRH) analogs, agonist analogs and antagonist analogs can be used to treat spinal cord injury and shock.

Erythropoietin (EPO) analogs, agonist analogs and antagonist analogs can be used to treat anemia.

Fibroblast growth factor (FGF), receptor analogs, agonist analogs and antagonist analogs can be as stimulation of bone formation, as well as used as a treatment for Kaposi's sarcoma, neuron regeneration, prostate growth, tumor growth inhibition, and angiogenesis.

Stem cell factor analogs, agonist analogs and antagonist analogs can be used to treat anemias. GP120, GP160, CD4 fragment peptides analogs, agonist analogs and antagonist analogs can be used to treat HIV and AIDS.

Insulin-like growth factor (IGF) analogs, agonist analogs and antagonist analogs, and IGF receptor analogs, agonist analogs and antagonist analogs can be used to treat breast and other cancers, noninsulin-dependent diabetest mellitus, cell proliferation, apoptosis, hematopoiesis, HIV, AIDS, growth disorders, osteoporosis, and insulin resistance.

Colony stimulating factors (granulocyte-macrophage colony-stimulating factor (GMCSF), granulocyte colony-stimulating factor (GCSF), and macrophage colony-stimulating factor (MCSF) analogs, agonist analogs and antagonist analogs can be used to treat anemias.

Kentsin analogs, agonist analogs and antagonist analogs can be used for immunomodulation.

Lymphocyte activating peptide (LAP) analogs, agonist analogs and antagonist analogs can be used for immunomodulation. Examples of these peptides are described in Loleit, M.; Deres, K.; Wiesmuller, K. H.; Jung, G.; Eckert, M.; Bessler, W. G; Biological activity of the *Escherichia coli* lipoprotein: detection of novel lymphocyte activating peptide segments of the molecule and their conformational characterization. Biological Chemistry Hoppe-Seyler. 375 (6):407-12, June 1994.

Tuftsin analogs, agonist analogs and antagonist analogs can be used for immunomodulation.

Prolactin analogs, agonist analogs and antagonist analogs can be used to treat rheumatic diseases, systemic lupus erythematosus, and hyperprolactemia.

Angiotensin II analogs, agonist analogs and antagonist analogs and Angiotensin II receptor(s) analogs, agonist analogs and antagonist analogs can be used to treat hypertension, hemodynamic regulation, neurological disorders, diabetic nephropathies, aortoarterities induced RVH, hyperaldosteronism, heavy metal induced cardiovascular effects, diabetes mellitus and thyroid dysfunction.

Dynorphin analogs, agonist analogs and antagonist analogs can be used to treat neurological disorders, pain management, algesia, spinal cord injury and epilepsy.

Calcitonin analogs, agonist analogs and antagonist analogs can be used to treat neurological disorders, immune system dysfunction, calcium homeostasis, and osteoporosis.

Pituitary adenylate cyclase activating polypeptide analogs, agonist analogs and antagonist analogs may modulate growth, signal transduction vasoactivity roles.

Cholecystokinin analogs, agonist analogs and antagonist analogs can be used to treat feeding disorders, panic disorders, and anti-opioid properties.

Pepstatin analogs, agonist analogs and antagonist analogs can be used as pepsin and HIV protease inhibitors (AIDS).

Bestatin analogs, agonist analogs and antagonist analogs can be used to treat muscular dystrophy, anticancer, antileukemia, immune response modulator, and acute non-lymphocytic leukemia.

Leupeptin analogs, agonist analogs and antagonist analogs can be used as a protease inhibitor, exact role in diseases not determined yet.

Luteinizing hormone and releasing hormone analogs, agonist analogs and antagonist analogs can be used as a infertility male contraceptive.

Neurotensin analogs, agonist analogs and antagonist analogs can be used, e.g., as antipsychotic, analgesic, anticancer, and/or neuroprotective agents, e.g., for treating stroke victims, e.g., by inducing hypothermia so as to provide neuroprotection.

Motilin analogs, agonist analogs and antagonist analogs can be used for the control of gastric emptying.

Insulin analogs, agonist analogs and antagonist analogs can be used to treat diabetes.

Transforming growth factor (TGF) analogs, agonist analogs and antagonist analogs can be used for cell proliferation and differentiation, cancer treatment, immunoregulation, therapy for donor tissue limitations, and wound-healing constraints in surgery.

Bone morphogenetic proteins (BMPs) analogs, agonist analogs and antagonist analogs can be used as therapy for donor tissue limitations, osteogenesis, and wound-healing constraints in surgery.

Bombesin and Enterostatin analogs, agonist analogs and antagonist analogs can be used to prevent the proliferation of tumor cells, modulation of feeding, and neuroendocrine functions. These peptides fall within a supercategory of the neuromedins described above. These peptides are described in such exemplary references as Yamada K. Wada E. Wada K. Bombesin-like peptides: studies on food intake and social behaviour with receptor knock-out mice. Annals of Medicine. 32(8):519-29, November 2000; Ohki-Hamazaki H. Neuromedin B. Progress in Neurobiology. 62(3):297-312, October 2000; Still CD. Future trends in weight management. Journal of the American Osteopathic Association. 99(10 Su Pt 2):518-9, 1999; Martinez V. Tache Y. Bombesin and the brain-gut axis. Peptides. 21(11):1617-25, 2000; Afferent signals regulating food intake. Proceedings of the Nutrition Society. 59(3):373-84, 2000; Takenaka Y. Nakamura F. Jinsmaa Y. Lipkowski A W. Yoshikawa M. Enterostatin (VPDPR) has anti-analgesic and anti-amnesic activities. Bioscience Biotechnology & Biochemistry. 65(1):236-8, 2001 J.

Glucagon, glucagon-like peptide 1 analogs, agonist analogs and antagonist analogs can be used to treat diabetes cardiovascular emergencies.

Pancreastatin, chromogranins A, B and C analogs, agonist analogs and antagonist analogs—conditions associated with inhibition of insulin secretion, exocrine pancreatic secretion and gastric acid secretion, and stimulation of secretion.

Endorphins analogs, agonist analogs and antagonist analogs can be used to treat neurological disorders, alleviating pain, treatment of opioid abuse, obesity, and diabetes. Examples of these peptides are named and described in Dalayeun, J. F.; Nores, J. M.; Bergal, S.; Physiology of beta-endorphins. A close-up view and a review of the literature. Biomedicine & Pharmacotherapy. 47(8):311-20, 1993.

Miscellaneous opioid peptides analogs, agonist analogs and antagonist analogs, including (but not limited to) adrenal peptide E analogs, alpha casein fragment analogs, beta casomorphin analogs, dermorphin analogs, kyotorphin analogs, metophamide neuropeptide FF (NPFF) analogs, melanocyte inhibiting factor analogs, agonist analogs and antagonist analogs can be used to treat neurological disorders, alleviating pain, as well as for the treatment of opioid abuse.

Vasotocin analogs, agonist analogs and antagonist analogs can be used for sleep disorders including but not limited to insomnia.

Protein kinase C and inhibitors analogs, agonist analogs and antagonist analogs can be used to treat cancer, apoptosis, smooth muscle function, and Alzheimer's disease. Examples of these peptides are named and described in Philip, P. A.; Harris, A. L; Potential for protein kinase C inhibitors in cancer therapy. Cancer Treatment & Research. 78:3-27, 1995.

Amyloid, amyloid fibrin, analogs, agonist analogs and antagonist analogs can be used to treat neurodegenerative diseases and diabetes.

Calpain and other calmodulin-inhibitory protein analogs, agonist analogs and antagonist analogs can be used to treat neurodegenerative disorders, cerebral ischaemia, cataracts, myocardial ischaemia, muscular dystrophy and platelet aggregation.

Charybdotoxin and Apamin analogs, agonist analogs and antagonist analogs can be used for treatment of neurodegenerative diseases and pain and cerebral ischemia.

Phospholipase A2 analogs, agonist analogs and antagonist analogs and Phospholipase A2 receptor inhibiting/activating peptides analogs, agonist analogs and antagonist analogs can be used to treat acute pancreatitis, pancreatic cancer, abdominal trauma, and inflammation, e.g., sepsis, infections, acute pancreatitis, various forms of arthritis, cancer, complications of pregnancy, and postoperative states.

Potassium channel activating and inhibiting analogs, agonist analogs and antagonist analogs can be used to treat various diseases. Examples of these peptides are described in Edwards, G.; Weston, A. H; Pharmacology of the potassium channel openers. Cardiovascular Drugs & Therapy. 9 Suppl 2:185-93, March 1995.

IgG activators, inhibitors analogs, agonist analogs and antagonist analogs can be used to treat autoimmune diseases and immune dysfunctions. Examples of these peptides are described in Mouthon, L.; Kaveri, S. V.; Spalter, S. H.; Lacroix-Desmazes, S.; Lefranc, C.; Desai, R.; Kazatchkine, M. D; Mechanisms of action of intravenous immune globulin in immune-mediated diseases. Clinical & Experimental Immunology. 104 Suppl 1:3-9, 1996.

Endotoxin and inhibitor analogs, agonist analogs and antagonist analogs can be used for decreasing cardiac output, systemic hypotension, decreased blood flow and $O_2$ delivery to tissues, intense pulmonary vasoconstriction and hypertension, bronchoconstriction, increased permeability, pulmonary oedema, ventilation-to-perfusion inequalities, hypoxaemia, and haemoconcentration. Examples of these peptides are named and described in Burrell, R; Human responses to bacterial endotoxin. Circulatory Shock. 43(3):137-53, July 1994.

Orphan receptor ligand analogs, agonist analogs and antagonist analogs (including but not limited to ADNF, Adrenomedullin, Apelin, Ghrelin, Mastoparan (MCD peptides), Melanin concentrating hormone, Nociceptin/Nocistatin, Orexin, Receptor activity modulating protein, Urotensin) can be used to treat obesity, weight problems, neuropathy, sleep deprivation, sleep disorder including insomnia, and lung cell repair. These orphan receptor ligands are described in such references as In DS. Orphan G protein-coupled receptor s and beyond. Japanese Journal of Pharmacology. 90(2): 101-6, 2002; Maguire J J. Discovering orphan receptor function using human in vitro pharmacology. Current Opinion in Pharmacology. 3(2):135-9, 2003; Szekeres P G. Functional assays for identifying ligands at orphan G protein-coupled receptor s. Receptor s & Channels. 8(5-6):297-308, 2002; Shiau A K. Coward P. Schwarz M. Lehmann J M. Orphan nuclear receptor s: from new ligand discovery technologies to novel signaling pathways. Current Opinion in Drug Discovery & Development. 4(5): 575-90, 2001; Civelli O. Nothacker H P. Saito Y. Wang Z. Lin S H. Reinscheid R K. Novel neurotransmitters as natural ligands of orphan G-protein-coupled receptor s. Trends in Neurosciences. 24(4):230-7, 2001; Darland T. Heinricher M M. Grandy D K. Orphan in F Q/nociceptin: a role in pain and analgesia, but so much more. Trends in Neurosciences. 21(5):215-21, 1998, the disclosures of which are incorporated herein by reference.

Another embodiment of the invention includes analogs of Glycoprotein inhibitors. The central role of platelet-rich thrombus in the pathogenesis of acute coronary syndromes (ACSs) is well-known. Glycoprotein (Gp IIb/IIIa) receptor analogs, agonist analogs and antagonist analogs can be used as potent modulators of platelet function that may be expected to affect favorably the natural history of ACSs. Exemplary references for this category include Bhatt D L. Topol E J. Current role of platelet glycoprotein IIb/IIIa inhibitors in acute coronary syndromes. JAMA. 284(12): 1549-58, 2000; Kereiakes D J. Oral blockade of the platelet glycoprotein IIb/IIIa receptor: fact or fancy?. American Heart Journal. 138(1 Pt 2):539-46, 1999; Bassand J P. Low-molecular-weight heparin and other antithrombotic agents in the setting of a fast-track revascularization in unstable coronary artery disease. Haemostasis. 30 Suppl 2:114-21; discussion 106-7, 2000.

Apo-lipoprotein A-I analogs, agonist analogs and antagonist analogs may increase the HDL levels of subjects upon administration. Analogs of the present invention that are homolgous to Apo-lipoprotein A-I may be useful to treat or prevent liver disease and inflammatory diseases including but not limited to artherosclerosis. Analogs of the present invention that are homolgous to Apo-lipoprotein A-I may be useful to increase the amount of formation of pre-β1 HDL in human plasma.

The cytokine analogs of the present invention may treat or prevent autoimmune disease, inflammatory disease, and dysfunctional growth or differentiation of cells such as cellular proliferative disorders, the development of neoplasia, tumors, and cancer.

The present invention provides for the use of an antibody or binding composition which specifically binds to a specified analog. in some embodiments the antibody specifically binds the analog derived from a mammalian polypeptide, e.g., a polypeptide derived from a primate, human, cat, dog, rat, or mouse. Antibodies can be raised to various analogs, including individual, polymorphic, allelic, strain, or species variants, and fragments thereof, both in their naturally occurring (full-length) forms or in their synthetic forms. Additionally, antibodies can be raised to the analogs in their inactive state or active state. Anti-idiotypic antibodies may also be used.

A number of immunogens may be selected to produce antibodies specifically reactive with ligand or receptor proteins. Synthetic analogs may serve as an immunogen for the production of monoclonal or polyclonal antibodies. Such antibodies may be used as antagonists or agonists for their targets modulating the disease state associated with the naturally occurring proteins and analogs listed above. Synthetic polypeptides of the claimed invention may also be used either in pure or impure form. Synthetic peptides, made using the appropriate protein sequences, may also be used as an immunogen for the production of antibodies. Naturally folded or denatured material can be used, as appropriate, for producing antibodies. Either monoclonal or polyclonal antibodies may be generated, e.g., for subsequent use in immunoassays to measure the protein, or for immunopurification methods. Methods of producing polyclonal antibodies are well known to those of skill in the art.

Typically, an immunogen, such as a purified analog of the invention, is mixed with an adjuvant and animals are immunized with the mixture. The animal's immune response to the immunogen preparation is monitored by taking test bleeds and determining the titer of reactivity to the protein of interest. For example, when appropriately high titers of antibody to the immunogen are obtained, usually after repeated immunizations, blood is collected from the animal and antisera are prepared. Further fractionation of the antisera to enrich for antibodies reactive to the protein can be performed if desired. See, e.g., Harlow and Lane; or Coligan. Immunization can also be performed through other methods, e.g., DNA vector immunization. See, e.g., Wang, et al. (1997) Virology 228:278-284.

Monoclonal antibodies may be obtained by various techniques familiar to researchers skilled in the art. Typically, spleen cells from an animal immunized with a desired analog are immortalized, commonly by fusion with a myeloma cell. See, Kohler and Milstein (1976) Eur. J. Immunol. 6:511-519. Alternative methods of immortalization include transformation with Epstein Barr Virus, oncogenes, or retroviruses, or other methods known in the art. See, e.g., Doyle, et al. (eds. 1994 and periodic supplements) Cell and Tissue Culture: Laboratory Procedures, John Wiley and Sons, New York, N.Y. Colonies arising from single immortalized cells are screened for production of antibodies of the desired specificity and affinity for the antigen, and yield of the monoclonal antibodies produced by such cells may be enhanced by various techniques, including injection into the peritoneal cavity of a vertebrate host. Alternatively, one may isolate DNA sequences which encode a monoclonal antibody or a binding fragment thereof by screening a DNA library from human B cells according, e.g., to the general protocol outlined by Huse, et al. (1989) Science 246:1275-1281.

Antibodies or binding compositions, including binding fragments, single chain antibodies, $F_v$, $F_{ab}$, single domain $V_H$, disulfide-bridged $F_v$, single-chain $F_v$ or $F_{(ab')_2}$ fragments of antibodies, diabodies, and triabodies against predetermined fragments of the analogs can be raised by immunization of animals with analogs or conjugates of analogs or receptor proteins with carrier proteins. Monoclonal antibodies are prepared from cells secreting the desired antibody. These antibodies can be screened for binding to analogs described herein. These monoclonal antibodies will usually bind with at least a $K_D$ of about 1 mM, usually at least about 300 μM, typically at least about 10 μM, at least about 30 μM, at least about 10 μM, and at least about 3 μM or more. These antibodies can be screened for binding to the naturally occurring polypeptides upon which the analogs are derived.

In some instances, it is desirable to prepare monoclonal antibodies (mAbs) from various mammalian hosts, such as mice, rodents, primates, humans, etc. Description of techniques for preparing such monoclonal antibodies may be found in, e.g., Stites, et al. (eds.) Basic and Clinical Immunology, 4th ed., Lange Medical Publications, Los Altos, Calif., and references cited therein; Harlow and Lane (1988) Antibodies: A Laboratory Manual CSH Press; Goding (1986) Monoclonal Antibodies: Principles and Practice, 2nd ed., Academic Press, New York, N.Y.; and particularly in Kohler and Milstein (1975) Nature 256:495-497, which discusses one method of generating monoclonal antibodies. Summarized briefly, this method involves injecting an animal with an analog described herein. The animal is then sacrificed and cells taken from its spleen, which are then fused with myeloma cells. The result is a hybrid cell or "hybridoma" that is capable of reproducing in vitro. The population of hybridomas is then screened to isolate individual clones, each of which secrete a single antibody species to the analog. In this manner, the individual antibody species obtained are the products of immortalized and cloned single B cells from the immune animal generated in response to a specific site recognized on the immunogenic substance.

Other suitable techniques involve selection of libraries of antibodies in phage or similar vectors. See, e.g., Huse, et al. (1989) Science 246:1275-1281; and Ward, et al. (1989) Nature 341:544-546. The polypeptides and antibodies of the present invention may be used with or without modification, including chimeric or humanized antibodies. Frequently, the polypeptides and antibodies will be labeled by joining, either covalently or non-covalently, a substance which provides for a detectable signal. A wide variety of labels and conjugation techniques are known and are reported extensively in both the scientific and patent literature. Suitable labels include radionuclides, enzymes, substrates, cofactors, inhibitors, fluorescent moieties, chemiluminescent moieties, magnetic particles, and the like. Patents teaching the use of such labels include U.S. Pat. Nos. 3,817,837; 3,850,752; 3,939,350; 3,996,345; 4,277,437; 4,275,149; and 4,366,241. Also, recombinant immunoglobulins may be produced, see, Cabilly, U.S. Pat. No. 4,816,567; and Queen, et al. (1989) Proc. Nat'l Acad. Sci. USA 86:10029-10033; or made in transgenic mice, see Mendez, et al. (1997) Nature Genetics 15:146-156; also see Abgenix and Medarex technologies.

The instant invention is related to pharmaceutical compositions of the instant invention or the pharmaceutical acceptable salts derived therefrom that comprise analogs that comprise isotopes. In some embodiments, the compositions of the claimed invention may contain any isotope described in Cyr and Pearson (Stabilization of radiopharmaceutical compositions using hydrophilic thioethers and hydrophilic 6-hydroxy chromans. Cyr, John E.; Pearson, Daniel A. (Diatide, Inc., USA). PCT Int. Appl. (2002), WO 200260491 A2 20020808), which is herein incorporated by reference. In some embodiments the compositions of the invention comrpsie analog that comprise one or more of the following isotopes: $^{125}I$, $^{131}I$, $^{211}At$, $^{47}Sc$, $^{67}Cu$, $^{72}Ga$, $^{90}Y$, $^{153}Sm$, $^{159}Gd$, $^{165}Dy$, $^{166}Ho$, $^{175}Yb$, $^{177}Lu$, $^{212}Bi$, $^{213}Bi$, $^{68}Ga$, $^{99}Tc$, $^{111}In$, $^{123}I$, and $^{3}H$.

The pharmaceutical compositions of the instant invention or the pharmaceutical acceptable salts derived therefrom may be in a liquid or solid dosage form. Such compositions may include any type of dosage form such as tablets, capsules, powders, liquid formulations, delayed or sustained release, patches, snuffs, nasal sprays and the like. The formulations may additionally include other ingredients such as dyes, preservatives, buffers and anti-oxidants, for example. The physical form and content of the pharmaceutical formulations contemplated are conventional preparations that can be formulated by those skilled in the pharmaceutical formulation field and are based on well established principles and compositions described in, for example, *Remington: The Science and Practice of Pharmacy*, 19th Edition, 1995; British Pharmacopoeia 2000, each of which is incorporated herein by reference. The compositions of the present invention may also include other active agents useful in the treatment of cardiovascular conditions. Solid forms can be prepared according to any means suitable in the art. For example, capsules are prepared by mixing the analog composition with a suitable diluent and filling the proper amount of the mixture in capsules. Tablets are prepared by direct compression, by wet granulation, or by dry granulation. Their formulations usually incorporate diluents, binders, lubricants and disintegrators as well as the compound. Diluents, but are not limited to, include various types of starch, cellulose, crystalline cellulose, microcrystalline cellulose, lactose, fructose, sucrose, mannitol or other sugar alcohols, kaolin, calcium phosphate or sulfate, inorganic salts such as sodium chloride and powdered sugar. Powdered cellulose derivatives are also useful. Non-limiting examples of tablet binders include, but are not limited to, starches, gelatin and sugars such as lactose, fructose, glucose and the like. Natural and synthetic gums are also convenient, including, but are not limited to, acacia, alginates, methylcellulose, polyvinylpyrrolidone and the like. Polyethylene glycol, ethylcellulose and waxes can also serve as binders.

A lubricant can be used in a tablet formulation to prevent the tablet and punches from sticking in the die. The lubricant include, but are not limited to, such slippery solids as talc, magnesium and calcium stearate, stearic acid and hydrogenated vegetable oils.

Tablets can be coated with sugar as a flavor and sealant, or with film-forming protecting agents to modify the dissolution properties of the tablet. The compounds may also be formulated as chewable tablets, by using large amounts of pleasant-tasting substances such as mannitol in the formulation, as is now well-established in the art.

Also contemplated are liquid formulations and solid form preparations which are intended to be converted, shortly before use, to liquid form preparations. Such liquid forms include, but are not limited to, solutions, suspensions, syrups, slurries, and emulsions. Liquid preparations may be prepared by conventional means with pharmaceutically acceptable additives such as suspending agents (e.g., sorbitol syrup, cellulose derivatives or hydrogenated edible fats or oils); emulsifying agents (e.g., lecithin or acacia); non-aqueous vehicles (e.g., almond oil, oily esters, or fractionated vegetable oils); and preservatives (e.g., methyl or propyl-p-hydroxybenzoates or sorbic acid). These preparations may contain, in addition to the active agent, colorants, flavors, stabilizers, buffers, artificial and natural sweeteners, dispersants, thickeners, solubilizing agents, and the like. The compositions may be in powder form for constitution with a suitable vehicle such as sterile water, saline solution, or alcohol, before use. Preparations may also contain mucosal enhancers.

In some embodiments, the oral transmucosal solid dosage further comprises a permeation enhancer. In some embodiments, the permeation enhancer is chosen from: a bile salt, sodium dodecyl sulfate, dimethyl sulfoxide, sodium lauryl sulfate, a derivative of a saturated or a unsaturated fatty acid, a surfactant, a bile salt analog, and a derivative of a bile salt. In some embodiments the oral transmucosal dosage form is chosen from: a chewing gum, a patch, a lozenge, a lozenge-on-a-handle, a tablet, a troche, a pastille, a sachet, a sublingual tablet, and a rapid disintegrating tablet. In some embodiments, the oral transmucosal solid dosage form of wherein the composition further comprises at least one flavoring agent, artificial coloring, sweetener, lubricating agent, disintegration agent, lubricating agent, diluent, base, or buffering agent. In some embodiments, the oral transmucosal solid dosage form further comprises a sustained release agent. The invention is directed to an oral transmucosal solid dosage form comprising from wherein the concentration of analog is from about 0.01% to about 90% of the dry matter weight of the composition.

Solid dosage forms such as lozenges and tablets may also be used for oral transmucosal delivery of pharmaceuticals. For example, nitroglycerin sublingual tablets have been on the market for many years. The sublingual tablets are designed to deliver small amounts of the potent nitroglycerin, which is almost immediately dissolved and absorbed. On the other hand, most lozenges or tablets are typically designed to dissolve in the mouth over a period of at least several minutes which allows extended dissolution of the lozenge and absorption of the drug.

Administration of lozenges or sublingual tablets generally utilize an "open" delivery system, in which the drug delivery conditions are influenced by the conditions of the surrounding environment, such as rate of saliva secretion, pH of the saliva, or other conditions beyond the control of the formulation.

A lozenge-on-a-handle (similar to a lollipop) is another dosage form suitable for transmucosal drug delivery. In addition to being non-invasive and providing a particularly easy method of delivery, the lozenge-on-a-handle (or lozenge with an integrated oral transmucosal applicator) dosage form allows a patient or caregiver to move the dosage form in and out of the mouth to titrate the dose. This practice is called dose-to-effect, in which a patient or caregiver controls the administration of the dose until the expected therapeutic effect is achieved. This is particularly important for certain symptoms, such as pain, nausea, motion sickness, and premedication prior to anesthesia because each patient needs a different amount of medication to treat these symptoms. For these types of treatments, the patient is the only one who knows how much medication is enough. Once the appropriate amount of drug is delivered, the patient or caregiver can remove the lozenge-on-a-handle, thus, stopping delivery of the drug. This feature is especially important for particularly potent drugs, which may present a significant advantage of terminating drug administration once the desired effect is achieved.

As used herein, the term "oral transmucosal delivery" (OTD) refers to the delivery of a pharmaceutical agent across a mucous membrane in the oral cavity, pharyngeal cavity, or esophagus, and may be contrasted, for example, with traditional oral delivery, in which absorption of the drug occurs in the intestines. Accordingly, routes of administration in which the pharmaceutical agent is absorbed through the buccal, sublingual, gingival, pharyngeal, and/or esophageal mucosa are all encompassed within "oral transmucosal delivery," as that term is used herein. Oral transmucosal delivery involves the administration of an oral transmucosal solid dosage form to the oral cavity of a patient, which is held in the oral cavity and dissolved, thereby releasing the pharmaceutical agent for oral transmucosal delivery. Of course, as the solid dosage form dissolves in the oral cavity, some of the saliva containing the pharmaceutical agent may be swallowed, and a portion of the drug may ultimately be absorbed from the intestines.

The compositions of the invention can be administered in a sustained release composition, such as those described in, for example, U.S. Pat. No. 5,672,659 and U.S. Pat. No. 5,595,760, and herein incorporate by reference. The use of immediate or sustained release compositions depends on the type of condition being treated.

The pharmaceutical compositions of the instant invention or the pharmaceutical acceptable salts derived therefrom may be in a dosage amount in an effective amount for inducing or increasing the naturally occurring biological activity of the wild-type polypeptide upon which the analog is derived. The pharmaceutical compositions of the instant invention or the pharmaceutical acceptable salts derived therefrom may be in a dosage amount in an effective amount for inducing or increasing the naturally occurring biological activity of the wild-type secretin polypeptide upon which the analog is derived. The pharmaceutical compositions of the instant invention or the pharmaceutical acceptable salts derived therefrom may be in a dosage amount in an effective amount for increasing the half-life of the composition when administered to a human being or other subject. In some embodiments the secretin analog is VIP.

The present invention also encompasses methods of using the compositions comprising a VIP analog. Any of these methods may involve the administration of a pharmaceutical composition comprising a VIP analog wherein the VIP analog is in a therapeutically effective dose. Any of these methods may involve the administration of a pharmaceutical composition comprising a VIP analog wherein the VIP analog is selective for VPAC1, VPAC2, PAC1, VIPR1, or VIPR2. The composition comprising an analog of the invention produces a broad range of activities, depending on the dosage administered. The present invention encompasses methods of treating or preventing pulmonary hypertension, primary arterial hypertension, pulmonary hypertension associated to post-ventricular septal defect, idiopathic pulmonary fibrosis, idiopathic pulmonary arterial hypertension, CREST syndrome—Calcinosis; Raynaud's disease; loss of muscle control of the Esophagus; Sclerodactyly; Telangiectasia, Acute respiratory distress, congestive heart failure, chronic obstructed pulmonary disorder, asthma, chronic obstructive pulmonary disease, sarcoidosis, small lung cell cancer, autoimmune disease, inflammatory disease, sepsis, Hirschsprung's Disease, sexual dysfunction, erectile dysfunction, Parkinson's disease, Alzheimer's disease, circadian rhythm dysfunction, pain, colorectal cancer, hepatocellular cancer, elevated blood pressure levels, elevated blood glucose levels, hyperglycemia, diabetes, insulin resistance, metabolic acidosis, obesity, Type I diabetes, Type II diabetes Multiple Sclerosis, osteoporosis, Sjogren's syndrome, pancreatitis, uveoretinitis, osteoporosis, female sexual dysfunction comprising administering to at least one patient in need thereof, mammal in need thereof or human in need thereof a composition or pharmaceutical composition comprising a secretin family analog in a therapeutically effective amount. The compositions of the invention may also be used at lower doses in order to prevent pulmonary hypertension, primary arterial hypertension, pulmonary hypertension associated to post-ventricular septal defect, idiopathic pulmonary fibrosis, idiopathic pulmonary arterial hypertension, CREST syndrome—Calcinosis; Raynaud's disease; loss of muscle control of the Esophagus; Sclerodactyly; Telangiectasia, Acute respiratory distress, congestive heart failure, chronic obstructed pulmonary disorder, asthma, chronic obstructive pulmonary disease, sarcoidosis, small lung cell cancer, autoimmune disease, inflammatory disease, sepsis, Hirschsprung's Disease, sexual dysfunction, erectile dysfunction, Parkinson's disease, Alzheimer's disease, circadian rhythm dysfunction, pain, colorectal cancer, hepatocellular cancer, elevated blood pressure levels, elevated blood glucose levels, hyperglycemia, diabetes, insulin resistance, metabolic acidosis, obesity, Type I diabetes, Type II diabetes Multiple Sclerosis, osteoporosis, Sjogren's syndrome, pancreatitis, uveoretinitis, osteoporosis, female sexual dysfunction in a subject in need thereof. The compositions of the invention may also be used to prevent pulmonary hypertension, primary arterial hypertension, pulmonary hypertension associated to post-ventricular septal defect, idiopathic pulmonary fibrosis, idiopathic pulmonary arterial hypertension, CREST syndrome—Calcinosis; Raynaud's disease; loss of muscle control of the Esophagus; Sclerodactyly; Telangiectasia, Acute respiratory distress, congestive heart failure, chronic obstructed pulmonary disorder, asthma, chronic obstructive pulmonary disease, sarcoidosis, small lung cell cancer, autoimmune disease, inflammatory disease, sepsis, Hirschsprung's Disease, sexual dysfunction, erectile dysfunction, Parkinson's disease, Alzheimer's disease, circadian rhythm dysfunction, pain, colorectal cancer, hepatocellular cancer, elevated blood pressure levels, elevated blood glucose levels, hyperglycemia, diabetes, insulin resistance, metabolic acidosis, obesity, Type I diabetes, Type II diabetes Multiple Sclerosis, osteoporosis, Sjogren's syndrome, pancreatitis, uveoretinitis, osteoporosis, female sexual dysfunction in a subject susceptible to those indications. In some embodiments, the method of prevention comprising administering the composition or pharmaceutical compositions of the invention after the subject is tested for susceptibility or genetic propensity for developing the disease, indication or disorder.

The pharmaceutical composition comprising a pharmaceutically acceptable carrier/diluent and an analog comprising an α-amino acid and at least one β-amino acid may be formulated by one having ordinary skill in the art with compositions selected depending upon the chosen mode of administration. Suitable pharmaceutical carriers are described in the most recent edition of Remington's Pharmaceutical Sciences, A. Osol, a standard reference text in this field, which is incorporated herein in its entirety.

For parenteral administration, analog can be, for example, formulated as a solution, suspension, emulsion or lyophilized powder in association with a pharmaceutically acceptable parenteral vehicle. Examples of such vehicles are water, saline, Ringer's solution, dextrose solution, and 5% human serum albumin. Liposomes and nonaqueous vehicles such as fixed oils may also be used. The vehicle or lyophilized powder may contain additives that maintain isotonicity (e.g., sodium chloride, mannitol) and chemical stability (e.g., buffers and preservatives). The formulation is sterilized by commonly used techniques. For example, a parenteral composition suitable for administration by injection is prepared by dissolving 1.5% by weight of analog in 0.9% sodium chloride solution.

The present invention relates to routes of administration include intramuscular, sublingual, intravenous, intraperitoneal, intrathecal, intravaginal, intraurethral, intradermal, intrabuccal, via inhalation, via nebulizer and via subcutaneous injection. Alternatively, the pharmaceutical composition may be introduced by various means into cells that are removed from the individual. Such means include, for example, microprojectile bombardment and liposome or other nanoparticle device.

Solid dosage forms for oral administration include capsules, tablets, pills, powders and granules. In solid dosage forms, the analogs are generally admixed with at least one inert pharmaceutically acceptable carrier such as sucrose, lactose, starch, or other generally regarded as safe (GRAS) additives. Such dosage forms can also comprise, as is normal practice, an additional substance other than an inert diluent, e.g., lubricating agent such as magnesium state. With capsules, tablets, and pills, the dosage forms may also comprise a buffering agent. Tablets and pills can additionally be prepared with enteric coatings, or in a controlled release form, using techniques know in the art.

Liquid dosage forms for oral administration include pharmaceutically acceptable emulsions, solutions, suspensions and syrups, with the elixirs containing an inert diluent commonly used in the art, such as water. These compositions can also include one or more adjuvants, such as wetting agent, an emulsifying agent, a suspending agent, a sweetening agent, a flavoring agent or a perfuming agent.

In another embodiment of the invention the composition of the invention is used to treat a patient suffering from, or susceptible to, pulmonary hypertension, primary arterial hypertension, pulmonary hypertension associated to post-ventricular septal defect, idiopathic pulmonary fibrosis, idiopathic pulmonary arterial hypertension, CREST syndrome—Calcinosis; Raynaud's disease; loss of muscle control of the Esophagus; Sclerodactyly; Telangiectasia, Acute respiratory distress, congestive heart failure, chronic obstructed pulmonary disorder, asthma, chronic obstructive pulmonary disease, sarcoidosis, small lung cell cancer, autoimmune disease, inflammatory disease, sepsis, Hirschsprung's Disease, sexual dysfunction, erectile dysfunction, Parkinson's disease, Alzheimer's disease, circadian rhythm dysfunction, pain, colorectal cancer, hepatocellular cancer, elevated blood pressure levels, elevated blood glucose levels, hyperglycemia, diabetes, insulin resistance, metabolic acidosis, obesity, Type I diabetes, Type II diabetes Multiple Sclerosis, osteoporosis, Sjogren's syndrome, pancreatitis, uveoretinitis, osteoporosis, female sexual dysfunction due to administration of a medication that causes onset of or exacerbates symptoms of pulmonary hypertension, primary arterial hypertension, pulmonary hypertension associated to post-ventricular septal defect, idiopathic pulmonary fibrosis, idiopathic pulmonary arterial hypertension, CREST syndrome—Calcinosis; Raynaud's disease; loss of muscle control of the Esophagus; Sclerodactyly; Telangiectasia, Acute respiratory distress, congestive heart failure, chronic obstructed pulmonary disorder, asthma, chronic obstructive pulmonary disease, sarcoidosis, small lung cell cancer, autoimmune disease, inflammatory disease, sepsis, Hirschsprung's Disease, sexual dysfunction, erectile dysfunction, Parkinson's disease, Alzheimer's disease, circadian rhythm dysfunction, pain, colorectal cancer, hepatocellular cancer, elevated blood pressure levels, elevated blood glucose levels, hyperglycemia, diabetes, insulin resistance, metabolic acidosis, obesity, Type I diabetes, Type II diabetes Multiple Sclerosis, osteoporosis, Sjogren's syndrome, pancreatitis, uveoretinitis, osteoporosis, female sexual dysfunction in a subject. In some embodiments, the invention relates to compositions comprising a secretin family analog for treatment or prevention of pulmonary hypertension, primary arterial hypertension, pulmonary hypertension associated to post-ventricular septal defect, idiopathic pulmonary fibrosis, idiopathic pulmonary arterial hypertension, CREST syndrome—Calcinosis; Raynaud's disease; loss of muscle control of the Esophagus; Sclerodactyly; Telangiectasia, Acute respiratory distress, congestive heart failure, chronic obstructed pulmonary disorder, asthma, chronic obstructive pulmonary disease, sarcoidosis, small lung cell cancer, autoimmune disease, inflammatory disease, sepsis, Hirschsprung's Disease, sexual dysfunction, erectile dysfunction, Parkinson's disease, Alzheimer's disease, circadian rhythm dysfunction, pain, colorectal cancer, hepatocellular cancer, elevated blood pressure levels, elevated blood glucose levels, hyperglycemia, diabetes, insulin resistance, metabolic acidosis, obesity, Type I diabetes, Type II diabetes Multiple Sclerosis, osteoporosis, Sjogren's syndrome, pancreatitis, uveoretinitis, osteoporosis, female sexual dysfunction in a subject in need thereof, wherein said analog comprises an α-amino acid and at least one β-amino acid. In some embodiments, the secretin family analog of the invention comprises an analog of VIP.

One of skill in the art will recognize that the appropriate dosage of the compositions and pharmaceutical compositions may vary depending on the individual being treated and the purpose. For example, the age, body weight, and medical history of the individual patient may affect therapeutic efficacy of therapy. Further, a lower dosage of the composition may be needed to produce a transient cessation of symptoms, while a larger dose may be needed to produce a complete cessation of symptoms associated with the disease, disorder, or indication. A competent physician can consider these factors and adjust the dosing regimen to ensure the dose is achieving the desired therapeutic outcome without undue experimentation. It is also noted that the clinician and/or treating physician will know how and when to interrupt, adjust, and/or terminate therapy in conjunction with individual patient response. Dosages may also depend on the strength of the particular analog chosen for the pharmaceutical composition.

The dose of the composition or pharmaceutical compositions may vary. The dose of the composition may be once per day. In some embodiments, multiple doses may be administered to the subject per day. In some embodiments, the total dosage is administered in at least two application periods. In some embodiments, the period can be an hour, a day, a month, a year, a week, or a two-week period. In an additional embodiment of the invention, the total dosage is administered in two or more separate application periods, or separate doses.

In some embodiments, subjects can be administered the composition in which the composition is provided in a daily dose range of about 0.0001 mg/kg to about 5000 mg/kg of the weight of the subject. The dose administered to the subject can also be measured in terms of total amount of analog administered per day. In some embodiments, a subject is administered from about 0.001 to about 3000 milligrams of analog per day. In some embodiments, a subject is administered up to about 2000 milligrams of analog per day. In some embodiments, a subject is administered up to about 1800 milligrams of analog per day. In some embodiments, a subject is administered up to about 1600 milligrams of analog per day. In some embodiments, a subject is administered up to about 1400 milligrams of analog per day. In some embodiments, a subject is administered up to about 1200 milligrams of analog per day. In some embodiments, a subject is administered up to about 1000 milligrams of analog per day. In some embodiments, a subject is administered up to about 800 milligrams of analog per day. In some embodiments, a subject is administered from about 0.001 milligrams to about 700 milligrams of analog per dose. In some embodiments, a subject is administered up to about 700 milligrams of analog per dose. In some embodiments, a subject is administered up to about 600 milligrams of analog per dose. In some embodiments, a subject is administered up to about 500 milligrams of analog per dose. In some embodiments, a subject is administered up to about 400 milligrams of analog per dose. In some embodiments, a subject is administered up to about 300 milligrams of secretin analog per dose. In some embodiments, a subject is administered up to about 200 milligrams of analog per dose. In some embodiments, a subject is administered up to about 100 milligrams of analog per dose. In some embodiments, a subject is administered up to about 50 milligrams of analog per dose.

In some embodiments, subjects can be administered the composition in which the composition comprising a VIP analog or pharmaceutically acceptable salt thereof is administered in a daily dose range of about 0.0001 mg/kg to about 5000 mg/kg of the weight of the subject. In some embodiments, the composition comprising a VIP analog or pharmaceutically acceptable salt thereof is administered in a daily dosage of up about 450 mg/kg of the weight of the subject. In some embodiments, the composition comprising a VIP analog or pharmaceutically acceptable salt thereof is administered in a daily dosage of up about 400 mg/kg of the weight of the subject. In some embodiments, the composition comprising a VIP analog or pharmaceutically acceptable salt thereof is administered in a daily dosage of up about 350 mg/kg of the weight of the subject. In some embodiments, the composition comprising a VIP analog or pharmaceutically acceptable salt thereof is administered in a daily dosage of up about 300 mg/kg of the weight of the subject. In some embodiments, the composition comprising a VIP analog or pharmaceutically acceptable salt thereof is administered in a daily dosage of up about 250 mg/kg of the weight of the subject. In some embodiments, the composition comprising a VIP analog or pharmaceutically acceptable salt thereof is administered in a daily dosage of up about 200 mg/kg of the weight of the subject. In some embodiments, the composition comprising a VIP analog or pharmaceutically acceptable salt thereof is administered in a daily dosage of up about 150 mg/kg of the weight of the subject. In some embodiments, the composition comprising a VIP analog or pharmaceutically acceptable salt thereof is administered in a daily dosage of up about 100 mg/kg of the weight of the subject. In some embodiments, the composition comprising a VIP analog or pharmaceutically acceptable salt thereof is administered in a daily dosage of up about 50 mg/kg of the weight of the subject. In some embodiments, the composition comprising a VIP analog or pharmaceutically acceptable salt thereof is administered in a daily dosage of up about 25 mg/kg of the weight of the subject.

In some embodiments, the composition comprising a VIP analog or pharmaceutically acceptable salt thereof is administered in a daily dosage of up about 10 mg/kg of the weight of the subject. In some embodiments, the composition comprising a VIP analog or pharmaceutically acceptable salt thereof is administered in a daily dosage of up about 5 mg/kg of the weight of the subject. In some embodiments, the composition comprising a VIP analog or pharmaceutically acceptable salt thereof is administered in a daily dosage of up about 1 mg/kg of the weight of the subject. In some embodiments, the composition comprising a VIP analog or pharmaceutically acceptable salt thereof is administered in a daily dosage of up about 0.1 mg/kg of the weight of the subject. In some embodiments, the composition comprising a VIP analog or pharmaceutically acceptable salt thereof is administered in a daily dosage of up about 0.01 mg/kg of the weight of the subject. In some embodiments, the composition comprising a VIP analog or pharmaceutically acceptable salt thereof is administered in a daily dosage of up about 0.001 mg/kg of the weight of the subject. The dose administered to the subject can also be measured in terms of total amount of VIP analog administered per day.

In some embodiments, a subject in need thereof is administered from about 1 ng to about 500 µg of analog or pharmaceutically salt thereof per day. In some embodiments, a subject in need thereof is administered from about 1 ng to about 10 ng of analog or pharmaceutically salt thereof per day. In some embodiments, a subject in need thereof is administered from about 10 ng to about 20 ng of analog or pharmaceutically salt thereof per day. In some embodiments, a subject in need thereof is administered from about 10 ng to about 100 ng of analog or pharmaceutically salt thereof per day. In some embodiments, a subject in need thereof is administered from about 100 ng to about 200 ng of analog or pharmaceutically salt thereof per day. In some embodiments, a subject in need thereof is administered from about 200 ng to about 300 ng of analog or pharmaceutically salt thereof per day. In some embodiments, a subject in need thereof is administered from about 300 ng to about 400 ng of analog or pharmaceutically salt thereof per day. In some embodiments, a subject in need thereof is administered from about 400 ng to about 500 ng of analog or pharmaceutically salt thereof per day. In some embodiments, a subject in need thereof is administered from about 500 ng to about 600 ng of analog or pharmaceutically salt thereof per day. In some embodiments, a subject in need thereof is administered from about 600 ng to about 700 ng of analog or pharmaceutically salt thereof per day. In some embodiments, a subject in need thereof is administered from about 800 ng to about 900 ng of analog or pharmaceutically salt thereof per day. In some embodiments, a subject in need thereof is administered from about 900 ng to about 1 µg of analog or pharmaceutically salt thereof per day. In some embodiments, a subject in need thereof is administered from about 1 µg to about 100 µg of analog or pharmaceutically salt thereof per day. In some embodiments, a subject in need thereof is administered from about 100 µg to about 200 µg of analog or pharmaceutically salt thereof per day. In some embodiments, a subject in need thereof is administered from about 200 µg to about 300 µg of analog or pharmaceutically salt thereof per day. In some embodiments, a subject in need thereof is administered from about 300 µg to about 400 µg of analog or pharmaceutically salt thereof per day. In some embodiments, a subject in need thereof is administered from about 400 µg to about 500 µg of analog or pharmaceutically salt thereof per day. In some embodiments, a subject in need thereof is administered from about 500 µg to about 600 µg of analog or pharmaceutically salt thereof per day. In some embodiments, a subject in need thereof is administered from about 600 µg to about 700 µg of analog or pharmaceutically salt thereof per day. In some embodiments, a subject in need thereof is administered from about 800 µg to about 900 µg of analog or pharmaceutically salt thereof per day. In some embodiments, a subject in need thereof is administered from about 900 µg to about 1 mg of analog or pharmaceutically salt thereof per day.

In some embodiments, a subject in need thereof is administered from about 0.0001 to about 3000 milligrams of VIP analog or pharmaceutically salt thereof per day. In some embodiments, a subject is administered up to about 2000 milligrams of VIP analog or pharmaceutically salt thereof day. In some embodiments, a subject is administered up to about 1800 milligrams of VIP analog or pharmaceutically salt thereof per day. In some embodiments, a subject is administered up to about 1600 milligrams of VIP analog or pharmaceutically salt thereof per day. In some embodiments, a subject is administered up to about 1400 milligrams of VIP analog or pharmaceutically salt thereof per day. In some embodiments, a subject is administered up to about 1200 milligrams of VIP analog or pharmaceutically salt thereof per day. In some embodiments, a subject is administered up to about 1000 milligrams of VIP analog or pharmaceutically salt thereof per day. In some embodiments, a subject is administered up to about 800 milligrams of VIP analog or pharmaceutically salt thereof per day. In some embodiments, a subject is administered from about 0.0001 milligrams to about 700 milligrams of VIP analog or pharmaceutically salt thereof per dose. In some embodiments, a subject is administered up to about 700 milligrams of VIP analog or pharmaceutically salt thereof per dose. In some embodiments, a subject is administered up to about 600 milligrams of VIP analog or pharmaceutically salt thereof per dose. In some embodiments, a subject is administered up to about 500 milligrams of VIP analog or pharmaceutically salt thereof per dose. In some embodiments, a subject is administered up to about 400 milligrams of VIP analog or pharmaceutically salt thereof per dose. In some embodiments, a subject is administered up to about 300 milligrams of VIP analog or pharmaceutically salt thereof per dose. In some embodiments, a subject is administered up to about 200 milligrams of VIP analog or pharmaceutically salt thereof per dose. In some embodiments, a subject is administered up to about 100 milligrams of VIP analog or pharmaceutically salt thereof per dose. In some embodiments, a subject is administered up to about 50 milligrams of VIP analog or pharmaceutically salt thereof per dose. In some embodiments, a subject is administered up to about 25 milligrams of VIP analog or pharmaceutically salt thereof per dose. In some embodiments, a subject is administered up to about 15 milligrams of VIP analog or pharmaceutically salt thereof per dose.

In some embodiments, a subject is administered up to about 10 milligrams of VIP analog or pharmaceutically salt thereof per dose. In some embodiments, a subject is administered up to about 5 milligrams of VIP analog or pharmaceutically salt thereof per dose. In some embodiments, a subject is administered up to about 1 milligram of VIP analog or pharmaceutically salt thereof per dose. In some embodiments, a subject is administered up to about 0.1 milligrams of VIP analog or pharmaceutically salt thereof per dose. In some embodiments, a subject is administered up to about 0.001 milligrams of VIP analog or pharmaceutically salt thereof per dose.

The dose administered to the subject can also be measured in terms of total amount of VIP analog or pharmaceutically salt thereof administered per ounce of liquid prepared. In some embodiments, the VIP analog or pharmaceutically salt thereof is at a concentration of about 2.5 grams per ounce of solution. In some embodiments, the VIP analog or pharmaceutically salt thereof is at a concentration of about 2.25 grams per ounce of solution. In some embodiments, the VIP analog or pharmaceutically salt thereof is at a concentration of about 2.25 grams per ounce of solution. In some embodiments, the VIP analog or pharmaceutically salt thereof is at a concentration of about 2.0 grams per ounce of solution. In some embodiments, the VIP analog or pharmaceutically salt thereof is at a concentration of about 1.9 grams per ounce of solution. In some embodiments, the VIP analog or pharmaceutically salt thereof is at a concentration of about 1.8 grams per ounce of solution. In some embodiments, the VIP analog or pharmaceutically salt thereof is at a concentration of about 1.7 grams per ounce of solution. In some embodiments, the VIP analog or pharmaceutically salt thereof is at a concentration of about 1.6 grams per ounce of solution. In some embodiments, the VIP analog or pharmaceutically salt thereof is at a concentration of about 1.5 grams per ounce of solution. In some embodiments, the VIP analog or pharmaceutically salt thereof is at a concentration of about 1.4 grams per ounce of solution. In some embodiments, the VIP analog or pharmaceutically salt thereof is at a concentration of about 1.3 grams per ounce of solution. In some embodiments, the VIP analog or pharmaceutically salt thereof is at a concentration of about 1.2 grams per ounce of solution. In some embodiments, the VIP analog or pharmaceutically salt thereof is at a concentration of about 1.1 grams per ounce of solution. In some embodiments, the VIP analog or pharmaceutically salt thereof is at a concentration of about 1.0 grams per ounce of solution. In some embodiments, the VIP analog or pharmaceutically salt thereof is at a concentration of about 0.9 grams per ounce of solution. In some embodiments, the VIP analog or pharmaceutically salt thereof is at a concentration of about 0.8 grams per ounce of solution. In some embodiments, the VIP analog or pharmaceutically salt thereof is at a concentration of about 0.7 grams per ounce of solution. In some embodiments, the VIP analog or pharmaceutically salt thereof is at a concentration of about 0.6 grams per ounce of solution. In some embodiments, the VIP analog or pharmaceutically salt thereof is at a concentration of about 0.5 grams per ounce of solution. In some embodiments, the VIP analog or pharmaceutically salt thereof is at a concentration of about 0.4 grams per ounce of solution. In some embodiments, the VIP analog or pharmaceutically salt thereof is at a concentration of about 0.3 grams per ounce of solution. In some embodiments, the VIP analog or pharmaceutically salt thereof is at a concentration of about 0.2 grams per ounce of solution. In some embodiments, the VIP analog or pharmaceutically salt thereof is at a concentration of about 0.1 grams per ounce of solution. In some embodiments, the VIP analog or pharmaceutically salt thereof is at a concentration of about 0.01 grams per ounce of solution. In some embodiments, the VIP analog or pharmaceutically salt thereof is at a concentration of about 0.001 grams per ounce of solution prepared. In some embodiments, the VIP analog or pharmaceutically salt thereof is at a concentration of about 0.0001 grams per ounce of solution prepared. In some embodiments, the VIP analog or pharmaceutically salt thereof is at a concentration of about 0.00001 grams per ounce of solution prepared. In some embodiments, the VIP analog or pharmaceutically salt thereof is at a concentration of about 0.000001 grams per ounce of solution prepared.

Dosage may be measured in terms of mass amount of analog per liter of liquid formulation prepared. One skilled in the art can increase or decrease the concentration of the analog in the dose depending upon the strength of biological activity desired to treat or prevent any above-mentioned disorders associated with the treatment of subjects in need thereof. For instance, one embodiment of the invention can include up to 0.00001 grams of analog per 5 mL of liquid formulation and up to about 10 grams of analog per 5 mL of liquid formulation.

In some embodiments the pharmaceutical compositions of the claimed invention comprise at least one other active agent. in some embodiments, the active agent is a vasoactive agent. In some embodiments the vasoactive agent is chosen from the naturally occurring prostaglandins prostaglandin E0 (PGE0, also referred to 13,14-dihydro-PGE1; hereinafter, the abbreviation "PG" is used for "prostaglandin"), PGE1, 19-hydroxy-PGE1, PGE2, 19-hydroxy-PGE2, PGA1, 19-hydroxy-PGA1, PGA2, 19-hydroxy-PGA2, PGB1, 19-hydroxy-PGB1, PGB2, 19-hydroxy-PGB2, PGB3, PGD2, PGF1α, PGF2α(dinoprost), PGF3α, PGI2 (prostacyclin), and combinations thereof. PGE0, PGE1, PGE2, and the hydrolyzable lower alkyl esters thereof (e.g., the methyl, ethyl and isopropyl esters) are, however, particularly suitable. Other suitable prostaglandins are exemplified, without limitation, by arboprostil, carbaprostacyclin, carboprost tromethamine, dinoprost tromethamine, dinoprostone, enprostil, iloprost, lipoprost, gemeprost, metenoprost, sulprostone, tiaprost, viprostil (CL 115,347), viprostil methyl ester, 16,16-dimethyl-Δ2-PGE1 methyl ester, 15-deoxy-16-hydroxy-16-methyl-PGE1 methyl ester (misoprostol), 16,16-dimethyl-PGE1, 11-deoxy-15-methyl-PGE1, 16-methyl-18,18,19,19-tetrahydrocarbacyclin, 16(RS)-15-deoxy-16-hydroxy-16-methyl-PGE1 methyl ester, (+)-4,5-didehydro-16-phenoxy-α-tetranor-PGE2 methyl ester, 11-deoxy-11α,16,16-trimethyl-PGE2, (+)-11α,16α,16 β-dihydroxy-1-(hydroxymethyl)-16-methyl-trans-prostene, 9-chloro-16,16-dimethyl-PGE2, 16,16-dimethyl-PGE2, 15(S)-15-methyl-PGE2, 9-deoxy-9-methylene-16,16-dimethyl-PGE2, potassium salt, 19(R)-hydroxy-PGE2, and 11-deoxy-16,16-dimethyl-PGE2. Additional vasoactive agents useful as secondary active agents herein include endothelin-derived relaxation factors ("EDRFs") such as nitric oxide releasing agents, e.g., sodium nitroprusside and diazenium diolates, or "NONOates." NONOates include, but are not limited to, (Z)-1-{N-methyl-N-{6-(N-methyl-ammoniohexyl)amino}}diazen-1-ium-1,2-diolate ("MAHMA/NO"), (Z)-1-{N-(3-ammoniopropyl)-N-(n-propyl)amino}-diazen-1-ium-1,2-diolate ("PAPA/NO"), (Z)-1-{N-{3-aminopropyl}-N-{4-(3-aminopropylammonio)butyl}amino}diazen-1-ium-1,2-diolate (spermine NONOate or "SPER/NO") and sodium (Z)-1-(N,N-diethyl amino)-diazen-1-ium-1,2-diolate (diethylamine NONOate or "DEA/NO") and derivatives thereof). Still other vasoactive agents include vasoactive intestinal polypeptide analogs and derivatives thereof (particularly derivatives in the form of hydrolyzable lower alkyl esters), smooth muscle relaxants, leukotriene inhibitors, calcium channel blockers, P2-adrenergic agonists, angiotensin-converting enzyme ("ACE") inhibitors, angiotensin II receptor antagonists, and phosphodiesterase inhibitors. Still other suitable vasoactive agents include, but are not limited to: nitrates and like compounds such as nitroglycerin, isosorbide dinitrate, erythrityl tetranitrate, amyl nitrate, molsidomine, linsidomine chlorhydrate ("SIN-1"), S-nitroso-N-acetyl-d,l-penicillamine ("SNAP") and S-nitroso-N-glutathione ("SNO-GLU"); long and short acting α-blockers such as phenoxybenzamine, dibenamine, doxazosin, terazosin, phentolamine, tolazoline, prazosin, trimazosin, alfuzosin, tamsulosin and indoramin; ergot alkaloids such as ergotamine and ergotamine analogs, e.g., acetergamine, brazergoline, bromerguride, cianergoline, delorgotrile, disulergine, ergonovine maleate, ergotamine tartrate, etisulergine, lergotrile, lysergide, mesulergine, metergoline, metergotamine, nicergoline, pergolide, propisergide, proterguride and terguride; antihypertensive agents such as diazoxide, hydralazine and minoxidil; nimodepine; pinacidil; cyclandelate; dipyridamole; isoxsuprine; chlorpromazine; haloperidol; yohimbine; and trazodone.

In some embodiments, the pharmaceutical compositions of the invention comprise an active agent that is an inhibitor of rho kinase, an enzyme belonging to the rhoA/rho associated kinase pathway, which regulates the state of phosphorylation of myosin phosphatase, in turn leading to the control of smooth muscle contraction. One example of a suitable rho kinase inhibitor has the following structural formula and is identified as Y-27632. Other suitable rho kinase inhibitors are disclosed, for example, in U.S. Pat. No. 6,218,410, which is herein incorporated by reference.

In some embodiments, the pharmaceutical compositions of the invention comprise an active agent that are peptide analogs of α-melanocyte-stimulating hormone (α-MSH), also referred to as "melanocortin peptides." Such peptides include the sequence His-Phe-Arg-Trp, His-D-Phe-Arg-Trp, or are homologs thereof, and can be cyclic. A suitable melanocortin peptide is Ac-Nle-cyclo(-Asp-His-D-Phe-Arg-Trp-Lys)-OH. See U.S. Pat. No. 6,051,555 to Hadley and International Patent Publication No. WO 01/00224 to Blood et al., assigned to Palatin Technologies, Inc. The aforementioned amino acid residues have their conventional meaning as given in Chapter 2422 of the Manual of Patent Examining Procedure (2000). Thus, "Arg" is arginine, "Nle" is norleucine, "His" is histamine, "Phe" is phenylalanine, "D-Phe" is D-phenylalanine, "Trp" is tryptophan, and "Ac" refers to an acetyl moiety, i.e., an acetyl moiety present in a peptide or amino acid sequence that is acetylated.

In some embodiments, the pharmaceutical compositions of the invention comprise an active agent that is an endothelin antagonists, including antagonists of any or all of the three isoforms of endothelin, i.e., ET-1, ET-2, and ET-3, and are exemplified by: phenoxyphenylacetic acids and derivatives thereof, such as N-(4-isopropylbenzene-sulfonyl)-α-(4-carboxy-2-n-propylphenoxy)-3,4-methylenedioxyphenyl acetamide dipotassium salt, 2-{(2,6-dipropyl-4-hydroxymethyl)-phenoxy}-2-(4-phenoxyphenyl)-acetic acid, 2-{(2,6-dipropyl-4-hydroxymethyl)phenoxy}-2-(4-phenylphenyl) acetic acid, 2-{(2,6-dipropyl-4-hydroxymethyl)phenoxy}-2-(3-carboxyphenyl)-acetic acid, 2-{(2,6-dipropyl-4-hydroxymethyl)phenoxy}-2-(3,4-ethylenedioxyphenyl) acetic acid, 2-{(2,6-dipropyl-4-hydroxymethyl)phenoxy}-2-(3,4,5-trimethoxyphenyl)acetic acid, 2-{(2,6-dipropyl-4-hydroxymethyl)phenoxy}-2-(3,4-methylenedioxyphenyl) acetic acid, N-(4-dimethylaminobenzenesulfonyl)-2-(4-methoxycarbonyl-2-propylphenoxy)-2-(3,4-methylenedioxyphenyl) acetamide, N-(2-methylbenzenesulfonyl)-2-(4-methoxycarbonyl-2-propylphenoxy)-2-(3,4-methylenedioxyphenyl)acetamide, N-(2-methoxycarbonyl-benzenesulfonyl)-2-(4-methoxycarbonyl-2-propylphenoxy)-2-(3,4-methylenedioxy-phenyl) acetamide, N-(2-chlorobenzene-sulfonyl)-2-(4-methoxycarbonyl-2-propylphenoxy)-2-(3,4-methylenedioxyphenyl) acetamide, and others, as described in U.S. Pat. No. 5,565,485; and certain isooxazoles, oxazoles, thiazoles, isothiazoles and imidazoles, as described, for example, in U.S. Pat. No. 6,136,828.

In some embodiments, the pharmaceutical compositions of the invention comprise an active agent that is a peptidyl drug including the peptidyl hormones activin, amylin, angiotensin, atrial natriuretic peptide (ANP), calcitonin, calcitonin gene-related peptide, calcitonin N-terminal flanking peptide, ciliary neurotrophic factor (CNTF), corticotropin (adrenocorticotropin hormone, ACTH), corticotropin-releasing factor (CRF or CRH), epidermal growth factor (EGF), follicle-stimulating hormone (FSH), gastrin, gastrin inhibitory peptide (GIP), gastrin-releasing peptide, gonadotropin-releasing factor (GnRF or GNRH), growth hormone releasing factor (GRF, GRH), human chorionic gonadotropin (hCH), inhibin A, inhibin B, insulin, luteinizing hormone (LH), luteinizing hormone-releasing hormone (LHRH), α-melanocyte-stimulating hormone, β-melanocyte-stimulating hormone, γ-melanocyte-stimulating hormone, melatonin, motilin, oxytocin (pitocin), pancreatic polypeptide, parathyroid hormone (PTH), placental lactogen, prolactin (PRL), prolactin-release inhibiting factor (PIF), prolactin-releasing factor (PRF), secretin, somatotropin (growth hormone, GH), somatostatin (SIF, growth hormone-release inhibiting factor, GIF), thyrotropin (thyroid-stimulating hormone, TSH), thyrotropin-releasing factor (TRH or TRF), thyroxine, and vasopressin. Other peptidyl drugs are the cytokines, e.g., colony stimulating factor 4, heparin binding neurotrophic factor (HBNF), interferon-α, interferon α-2a, interferon α-2b, interferon α-n3, interferon-β, etc., interleukin-1, interleukin-2, interleukin-3, interleukin-4, interleukin-5, interleukin-6, etc., tumor necrosis factor, tumor necrosis factor-α, granuloycte colony-stimulating factor (G-CSF), granulocyte-macrophage colony-stimulating factor (GM-CSF), macrophage colony-stimulating factor, midkine (MD), and thymopoietin.

In some embodiments, the pharmaceutical compositions of the invention comprise an active agent that is a selective androgen receptor modulators (SARMs) include LGD2226 and/or LGD1331, both available from Ligand Pharmaceuticals (San Diego, Calif.). See Negro-Villar et al. J. Clin. Endocrinol. & Metabol. 84(10):3459-62 (1999).

In some embodiments, the pharmaceutical compositions of the invention comprise an active agent that is a suitable neuropeptide including bradykinin, kallidin, des-Arg9-bradykinin, des-Arg10-kallidin, des-Arg9-{Leu8}-bradykinin, {D-Phe7}-bradykinin, HOE 140, neuropeptide Y, calcitonin gene-related peptide (cGRP), enkaphalins and related opioid peptides such as Met5-enkaphalin, Leu5-enkephalin, α-, β- and γ-endorphin, α- and β-neo-endorphin, and dynorphin, as well as the neurotransmitters GABA (γ-aminobutyric acid), glycine, glutamate, acetylcholine, dopamine, epinephrine, 5-hydroxytryptamine, substance P, serotonin, and catecholamines.

In some embodiments, the pharmaceutical compositions of the invention comprise an active agent that is a suitable serotonin agonists include, but are not limited to 2-methyl serotonin, buspirone, ipsaperone, tiaspirone, gepirone, ergot alkaloids, 8-hydroxy-(2-N,N-dipropyl-amino)-tetraline, 1-(4-bromo-2,5-dimethoxyphenyl)-2-aminopropane, cisapride, sumatriptan, m-chlorophenylpiperazine, trazodone, zacopride, mezacopride, and combinations thereof. Suitable serotonin antagonists include, for example, ondansetron, granisetron, metoclopramide, tropisetron, dolasetron, palonosetron, trimethobenzamide, methysergide, risperidone, ketanserin, ritanserin, clozapine, amitriptyline, MDL 100,907 (R(+)-α-(2,3-dimethoxyphenyl)-1-{2-(4-fluorophenyl)ethyl}-4-piperidine-methanol) (Marion Merrell Dow), azatadine, cyproheptadine, fenclonine, chlorpromazine, mianserin and combinations thereof.

In some embodiments, the pharmaceutical compositions of the invention comprise an active agent that is an ergot alkaloids include ergotamine and ergotamine analogs, e.g., acetergamine, brazergoline, bromerguride, cianergoline, delorgotrile, dihydroergotamine, disulergine, ergonovine, ergonovine maleate, ergotamine tartrate, etisulergine, lergotrile, lysergide, mesulergine, metergoline, metergotamine, nicergoline, pergolide, propisergide, proterguride and terguride.

In some embodiments, the pharmaceutical compositions of the invention comprise an active agent that is a calcium channel blockers that are suitable for use according to the present invention include, without limitation, amlodipine, felodipine, isradipine, nicardipine, nifedipine, nimodipine, nisoldipine, nitrendipine, bepridil, diltiazem, verapamil, and combinations thereof. In some embodiments, the pharmaceutical compositions of the invention comprise an active agent that is a potassium channel openers include, but are not limited to, pinacidil, diazoxide, cromakalim, nicorandil, minoxidil, (N-cyano-N'-(1,1-dimethylpropyl)-N"-3-pyridylguanidine (P-1075), and N-cyano-N'-(2-nitroxyethyl)-3-pridinecarboximidamide monomethanesulfonate (KRN 2391).

In some embodiments, the pharmaceutical compositions of the invention comprise an active agent that is a potassium channel blocker include tedisamil, agitoxin-2, apamin, BDS-I, BDS-II, charybdotoxin, α-dendrotoxin, β-dendrotoxin, γ-dendrotoxin, δ-dendrotoxin, dendrotoxin-I, dendrotoxin-K, E-4031, iberiotoxin, kaliotoxin, MCD-peptide, margatoxin, noxiustoxin, paxilline, penitrem A, stichodactyla, tertiapin, tityustoxin K alpha, verruculogen, and combinations thereof. Although all of the active agents are available commercially, most of the listed potassium channel blockers are available from Alomone Labs (Jerusalem, Israel).

In some embodiments, the pharmaceutical compositions of the invention comprise an active agent that is a dopamine agonist including, for example, levodopa, bromocriptine, pergolide, apomorphine, piribedil, pramipexole, ropinirole, and combinations thereof. Dopamine antagonists include, without limitation, spiroperidol, benperidol, trifluperidol, pimozide, fluphenazine, droperidol, haloperidol, thiothixene, trifluperazine, moperone, prochlorperazine, molindone, thioridazine, clozapine, chlorpromazine, promazine, sulpiride, clebopride, chlorpromazine, spiperone, flupenthixol, and combinations thereof.

In some embodiments, the pharmaceutical compositions of the invention comprise an active agent that is a non-androgenic steroid including progestins and estrogens. Suitable estrogens include synthetic and natural estrogens such as: estradiol (i.e., 1,3,5-estratriene-3,17β-diol, or "17β-estradiol") and its esters, including estradiol benzoate, valerate, cypionate, heptanoate, decanoate, acetate and diacetate; 17α-estradiol; ethinylestradiol (i.e., 17α-ethinylestradiol) and esters and ethers thereof, including ethinylestradiol 3-acetate and ethinylestradiol 3-benzoate; estriol and estriol succinate; polyestrol phosphate; estrone and its esters and derivatives, including estrone acetate, estrone sulfate, and piperazine estrone sulfate; quinestrol; mestranol; and conjugated equine estrogens. Suitable progestins include acetoxypregnenolone, allylestrenol, anagestone acetate, chlormadinone acetate, cyproterone, cyproterone acetate, desogestrel, dihydrogesterone, dimethisterone, ethisterone (17α-ethinyltestosterone), ethynodiol diacetate, flurogestone acetate, gestadene, hydroxyprogesterone, hydroxyprogesterone acetate, hydroxyprogesterone caproate, hydroxymethylprogesterone, hydroxymethylprogesterone acetate, 3-ketodesogestrel, levonorgestrel, lynestrenol, medrogestone, medroxyprogesterone acetate, megestrol, megestrol acetate, melengestrol acetate, norethindrone, norethindrone acetate, norethisterone, norethisterone acetate, norethynodrel, norgestimate, norgestrel, norgestrienone, normethisterone, and progesterone. It is generally desirable to co-administer a progestin along with an estrogen so that the estrogen is not "unopposed." As is well known in the art, estrogen-based therapies are known to increase the risk of endometrial hyperplasia and cancer, as well as the risk of breast cancer, in treated individuals. Co-administration of estrogenic agents with a progestin has been found to decrease the aforementioned risks.

The pharmaceutical compositions of the present invention may also include one or more chemotherapeutic agents. Suitable chemotherapeutic agents include, but are not limited to, platinum coordination compounds, topoisomerase inhibitors, antibiotics, antimitotic alkaloids and difluoronucleosides.

In one embodiment of the present invention, the chemotherapeutic agent is a platinum coordination compound. The term "platinum coordination compound" refers to any tumor cell growth inhibiting platinum coordination compound that provides the platinum in the form of an ion. Suitable platinum coordination compounds include, but are not limited to, cis-diamminediaquoplatinum (II)-ion; chloro (diethylenetriamine)-platinum (II) chloride; dichloro (ethylenediamine)-platinum (II); diammine (1,1-cyclobutanedicarboxylato) platinum (II) (carboplatin); spiroplatin; iproplatin; diammine (2-ethylmalonato)-platinum (II); ethylenediaminemalonatoplatinum (II); aqua (1,2-diaminodyclohexane)-sulfatoplatinum (II); (1,2-diaminocyclohexane) malonatoplatinum (II); (4-caroxyphthalato) (1,2-diaminocyclohexane) platinum (II); (1,2-diaminocyclohexane)-(isocitrato) platinum (II); (1,2-diaminocyclohexane) cis (pyruvato) platinum (II); (1,2-diaminocyclohexane) oxalatoplatinum (II); ormaplatin; and tetraplatin In some embodiments, the secretin analog and the additional active agent or agents may be incorporated into a single formulation, or they may be administered separately, either simultaneously or sequentially. In one embodiment, an androgenic agent is administered prior to administration of VIP or a VIP agonist, i.e., the androgenic agent is administered as a pretreatment. In some embodiments, such a method involves administration of an androgenic agent, e.g., via oral or topical (vulvar and/or vaginal) administration, followed by topical (again, vulvar and/or vaginal) administration of VIP or a VIP agonist.

In some embodiments, the formulations herein are administered by topical application to the vulvar region and/or by vaginal drug administration. These pharmaceutical formulations may typically contain one or more pharmaceutically acceptable carriers suited to the particular type of formulation, i.e., gel, ointment, suppository, or the like. The vehicles are comprised of materials of naturally occurring or synthetic origin that do not adversely affect the active agent or other components of the formulation. Suitable carriers for use herein include water, silicone, waxes, petroleum jelly, polyethylene glycol, propylene glycol, liposomes, sugars such as mannitol and lactose, and a variety of other materials, again depending, on the specific type of formulation used. As described in Section IV, infra, dosage forms used for administration to the vulvar region and/or vagina may be used to deliver drug on an as-needed, on-demand basis, and/or throughout an extended, sustained release profile.

The pharmaceutical compositions may also include a chemical compound to enhance permeation of the active agent through the mucosal tissue, i.e., a "permeation enhancer." Suitable permeation enhancers include those generally useful in conjunction with topical, transdermal or transmucosal drug delivery. Examples of suitable permeation enhancers include the following: sulfoxides such as dimethylsulfoxide (DMSO) and decylmethylsulfoxide (C10MSO); ethers such as diethylene glycol monoethyl ether (available commercially as TRANSCUTOL® (Gattefosse S. A., Saint-Priest, France) and diethylene glycol monomethyl ether; surfactants such as sodium laurate, sodium lauryl sulfate, cetyltrimethylammonium bromide, benzalkonium chloride, Poloxamer (231, 182, 184), TWEEN® (20, 40, 60, 80) (ICI Chemicals, Bridgewater, N.J.), and lecithin (U.S. Pat. No. 4,783,450); the 1-substituted azacycloheptan-2-ones, particularly 1-n-dodecylcyclaza-cycloheptan-2-one (available under the trademark AZONE® (Durham Pharmaceuticals, LLC, Durham, N.C.); see U.S. Pat. Nos. 3,989,816, 4,316,893, 4,405,616 and 4,557,934); alcohols such as ethanol, propanol, octanol, decanol, benzyl alcohol, and the like; fatty acids such as lauric acid, oleic acid and valeric acid; fatty acid esters such as isopropyl myristate, isopropyl palmitate, methylpropionate, and ethyl oleate; polyols and esters thereof such as propylene glycol, ethylene glycol, glycerol, butanediol, polyethylene glycol, and polyethylene glycol monolaurate (PEGML; see, e.g., U.S. Pat. No. 4,568,343); amides and other nitrogenous compounds such as urea, dimethylacetamide (DMA), dimethylformamide (DMF), 2-pyrrolidone, 1-methyl-2-pyrrolidone, ethanolamine, diethanolamine and triethanolamine; terpenes; alkanones; and organic acids, particularly salicylic acid and salicylates, citric acid and succinic acid. Mixtures of two or more enhancers may also be used.

In some embodiments, the pharmaceutical compositions may include an enzyme inhibitor, i.e., a compound effective to inhibit enzymes present in the vagina or vulvar area that could degrade or metabolize the active agent. That is, inhibitors of enzymes that decrease or eliminate the activity of the active agent may be included in the formulation so as to effectively inhibit the action of those enzymes. Such compounds include, for example, fatty acids, fatty acid esters, and NAD inhibitors.

In some embodiments, the pharmaceutical composition may be in the form of an ointment, cream, emulsion, lotion, gel, solid, solution, suspension, foam or liposomal formulation. Alternatively, the formulations may be contained within avaginal ring (e.g., as disclosed in U.S. Pat. No. 5,188,835 to Lindskog et al., assigned to Kabi Pharmacia AB), or within a tampon, suppository, sponge, pillow, puff, or osmotic pump system; these platforms are useful solely for vaginal delivery. Ointments are semisolid preparations that are typically based on petrolatum or other petroleum derivatives. The specific ointment base to be used, as will be appreciated by those skilled in the art, is one that will provide for optimum drug delivery. As with other carriers or vehicles, an ointment base should be inert, stable, non irritating and nonsensitizing. As explained in *Remington: The Science and Practice of Pharmacy*, supra, at pages 1034-1038, ointment bases may be grouped in four classes: oleaginous bases; emulsifiable bases; emulsion bases; and water-soluble bases. Oleaginous ointment bases include, for example, vegetable oils, fats obtained from animals, and semisolid hydrocarbons obtained from petroleum. Emulsifiable ointment bases, also known as absorbent ointment bases, contain little or no water and include, for example, hydroxystearin sulfate, anhydrous lanolin and hydrophilic petrolatum. Emulsion ointment bases are either water-in-oil (W/O) emulsions or oil-in-water (O/W) emulsions, and include, for example, cetyl alcohol, glyceryl monostearate, lanolin and stearic acid. Suitable water-soluble ointment bases are prepared from polyethylene glycols of varying molecular weight; again, reference may be had to Remington: The Science and Practice of Pharmacy for further information.

In one aspect of the invention, a method is provided for treating sexual dysfunction in a female individual comprising administering to the vagina and/or vulvar area a pharmaceutical formulation comprising a secretin family analog. In some embodiments, the secretin family analog is a vasodilator, with vasodilators selected from the group consisting of VIP and vasoactive intestinal polypeptide analogs and combinations of any of the foregoing. Any number of drug delivery platforms may be used, e.g., suppositories, ointments, creams, gels, solutions and the like. Also, one or more additional types of drugs, i.e., pharmacologically active agents may be incorporated into the pharmaceutical formulations. In other aspects of the invention, vaginal administration of a vasoactive agent as just described is used to improve vaginal muscle tone and tissue health, to enhance vaginal lubrication, or to minimize collagen misdeposition resulting from hypoxia as well as the associated lack of elasticity resulting from the collagen misdeposition.

In another embodiment of the invention, a method is provided for improving memory by administering a secretin family analog.

In another aspect of the invention, pharmaceutical compositions and dosage forms are provided for carrying out the aforementioned methods. The compositions and dosage forms contain a vasoactive agent as described above, a pharmaceutically acceptable vehicle, and, optionally, one or more additional pharmacologically active agents. The formulations contain a therapeutically effective amount of the active agent, or a therapeutically effective concentration of the active agent, i.e., a concentration that provides a therapeutically effective amount of active agent upon administration of a selected volume of composition.

The subject can be any animal, including but not necessarily limited to mammals such as a human, mouse, rat, hamster, guinea pig, rabbit, cat, dog, monkey, cow, horse, pig, and the like. In some embodiments, the subject is a human.

According to some embodiments of the invention, the formulation may be supplied as part of a kit. The kit comprise comprising an analog, wherein the analog comprises an α-amino acid and at least one β-amino acid. In another embodiment, the kit comprises a pharmaceutically acceptable salt of an analog with a rehydration mixture. In another embodiment, the pharmaceutically acceptable salt of an analog are in one container while the rehydration mixture is in a second container. The rehydration mixture may be supplied in dry form, to which water or other liquid solvent may be added to form a suspension or solution prior to administration. Rehydration mixtures are mixtures designed to solubilize a lyophilized, insoluble salt of the invention prior to administration of the composition to a subject takes at least one dose of a purgative. In another embodiment, the kit comprises a pharmaceutically acceptable salt in orally available pill form.

The kit may contain two or more containers, packs, or dispensers together with instructions for preparation and administration. In some embodiments, the kit comprises at least one container comprising the pharmaceutical composition or compositions described herein and a second container comprising a means for delivery of the compositions such as a syringe. In some embodiments, the kit comprises a composition comprising an analog in solution or lyophilized or dried and accompanied by a rehydration mixture. In some embodiments, the analog and rehydration mixture may be in one or more additional containers.

The compositions included in the kit may be supplied in containers of any sort such that the shelf-life of the different components are preserved, and are not adsorbed or altered by the materials of the container. For example, suitable containers include simple bottles that may be fabricated from glass, organic polymers, such as polycarbonate, polystyrene, polypropylene, polyethylene, ceramic, metal or any other material typically employed to hold reagents or food; envelopes, that may consist of foil-lined interiors, such as aluminum or an alloy. Other containers include test tubes, vials, flasks, and syringes. The containers may have two compartments that are separated by a readily removable membrane that upon removal permits the components of the compositions to mix. Removable membranes may be glass, plastic, rubber, or other inert material.

Kits may also be supplied with instructional materials. Instructions may be printed on paper or other substrates, and/or may be supplied as an electronic-readable medium, such as a floppy disc, CD-ROM, DVD-ROM, zip disc, videotape, audio tape, or other readable memory storage device. Detailed instructions may not be physically associated with the kit; instead, a user may be directed to an internet web site specified by the manufacturer or distributor of the kit, or supplied as electronic mail.

In another embodiment, a packaged kit is provided that contains the pharmaceutical formulation to be administered, i.e., a pharmaceutical formulation containing VIP analog or a for enhancing female sexual desire and responsiveness, a container (e.g., a vial, a bottle, a pouch, an envelope, a can, a tube, an atomizer, an aerosol can, etc.), optionally sealed, for housing the formulation during storage and prior to use, and instructions for carrying out drug administration in a manner effective to enhance sexual desire and responsiveness. The instructions will typically be written instructions on a package insert, a label, and/or on other components of the kit.

Depending on the type of formulation and the intended mode of administration, the kit may also include a device for administering the formulation (e.g., a transdermal delivery device). The administration device may be a dropper, a swab, a stick, or the nozzle or outlet of an atomizer or aerosol can. The formulation may be any suitable formulation as described herein. For example, the formulation may be an oral dosage form containing a unit dosage of the active agent, or a gel or ointment contained within a tube. The kit may contain multiple formulations of different dosages of the same agent. The kit may also contain multiple formulations of different active agents.

The present kits will also typically include means for packaging the individual kit components, i.e., the pharmaceutical dosage forms, the administration device (if included), and the written instructions for use. Such packaging means may take the form of a cardboard or paper box, a plastic or foil pouch, etc.

The invention relates to the use of an analog in the preparation of a medicament for treating or preventing chronic obstructive pulmonary disease, pulmonary hypertension, primary arterial hypertension, pulmonary hypertension associated to post-ventricular septal defect, idiopathic pulmonary fibrosis, idiopathic pulmonary arterial hypertension, CREST syndrome—Calcinosis; Raynaud's disease; loss of muscle control of the Esophagus; Sclerodactyly; Telangiectasia, Acute respiratory distress, congestive heart failure, chronic obstructed pulmonary disorder, asthma, chronic obstructive pulmonary disease, sarcoidosis, small cell lung carcinoma, autoimmune disease, inflammatory disease, sepsis, Hirschsprung's Disease, sexual dysfunction, erectile dysfunction, Parkinson's disease, Alzheimer's disease, circadian rhythm dysfunction, pain, colorectal cancer, hepatocellular cancer, elevated blood pressure levels, elevated blood glucose levels, hyperglycemia, diabetes, insulin resistance, metabolic acidosis, obesity, Type I diabetes, Type II diabetes Multiple Sclerosis, osteoporosis, Sjogren's syndrome, pancreatitis, uveoretinitis, osteoporosis, female sexual dysfunction due to administration of a medication that causes onset of or exacerbates symptoms of pulmonary hypertension, primary arterial hypertension, pulmonary hypertension associated to post-ventricular septal defect, idiopathic pulmonary fibrosis, idiopathic pulmonary arterial hypertension, CREST syndrome—Calcinosis; Raynaud's disease; loss of muscle control of the Esophagus; Sclerodactyly; Telangiectasia, Acute respiratory distress, congestive heart failure, chronic obstructed pulmonary disorder, asthma, chronic obstructive pulmonary disease, sarcoidosis, small cell lung carcinoma, autoimmune disease, inflammatory disease, sepsis, Hirschsprung's Disease, sexual dysfunction, erectile dysfunction, Parkinson's disease, Alzheimer's disease, circadian rhythm dysfunction, pain, colorectal cancer, hepatocellular cancer, elevated blood pressure levels, elevated blood glucose levels, hyperglycemia, diabetes, insulin resistance, metabolic acidosis, obesity, Type I diabetes, Type II diabetes Multiple Sclerosis, osteoporosis, Sjogren's syndrome, pancreatitis, uveoretinitis, osteoporosis, female sexual dysfunction in a subject in need thereof. In some embodiments, the invention relates to compositions comprising a secretin family analog for treatment or prevention of chronic obstructive pulmonary disease, pulmonary hypertension, primary arterial hypertension, pulmonary hypertension associated to post-ventricular septal defect, idiopathic pulmonary fibrosis, idiopathic pulmonary arterial hypertension, CREST syndrome—Calcinosis; Raynaud's disease; loss of muscle control of the Esophagus; Sclerodactyly; Telangiectasia, Acute respiratory distress, congestive heart failure, chronic obstructed pulmonary disorder, asthma, chronic obstructive pulmonary disease, sarcoidosis, small cell lung carcinoma, autoimmune disease, inflammatory disease, sepsis, Hirschsprung's Disease, sexual dysfunction, erectile dysfunction, Parkinson's disease, Alzheimer's disease, circadian rhythm dysfunction, pain, colorectal cancer, hepatocellular cancer, elevated blood pressure levels, elevated blood glucose levels, hyperglycemia, diabetes, insulin resistance, metabolic acidosis, obesity, Type I diabetes, Type II diabetes Multiple Sclerosis, osteoporosis, Sjogren's syndrome, pancreatitis, uveoretinitis, osteoporosis, female sexual dysfunction in a subject in need thereof.

The present invention relates to inhibiting secretion of TNF-$\alpha$ in a subject comprising administering a composition comprising an analog to a subject, wherein said analog comprises an $\alpha$-amino acid and at least one $\beta$-amino acid. In some embodiments the analog is a secretin family analog. In some embodiments the analog is a VIP analog. The present invention relates to inhibiting binding of VIP to a VIP receptor in a subject comprising administering a composition comprising an analog to a subject, wherein said analog comprises an $\alpha$-amino acid and at least one $\beta$-amino acid. In some embodiments the analog is a secretin family analog. In some embodiments the analog is a VIP analog. The present invention relates to inhibiting biological effect of GHRH in a subject comprising administering a composition comprising an analog to a subject, wherein said analog comprises an $\alpha$-amino acid and at least one $\beta$-amino acid. In some embodiments the analog is a secretin family analog. In some embodiments the analog is a VIP analog. The present invention relates to inhibiting chemotaxis of T cells in a subject comprising administering a composition comprising an analog to a subject, wherein said analog comprises an $\alpha$-amino acid and at least one $\beta$-amino acid. In some embodiments the analog is a secretin family analog. In some embodiments the analog is a VIP analog.

The present invention relates to inhibiting expression of LPS in a subject comprising administering a composition comprising an analog to a subject, wherein said analog comprises an $\alpha$-amino acid and at least one $\beta$-amino acid. In some embodiments the analog is a secretin family analog. In some embodiments the analog is a VIP analog.

The present invention relates to modulating the amount of cyclic cAMP in a subject comprising administering a composition comprising an analog to a subject, wherein said analog comprises an $\alpha$-amino acid and at least one $\beta$-amino acid. In some embodiments the analog is a secretin family analog. In some embodiments the analog is a VIP analog.

The present invention relates to increasing the activity or expression of adenylate cyclase in a subject comprising administering a composition comprising an analog to a subject, wherein said analog comprises an α-amino acid and at least one β-amino acid. In some embodiments the analog is a secretin family analog. In some embodiments the analog is a secretin family analog and a VPAC1 antagonist. In some embodiments the analog is a secretin family analog. and a VPAC2 agonist. In some embodiments the analog is a VIP analog. In some embodiments, the composition or pharmaceutical composition of the claimed invention comprises a VIP analog, wherein the VIP analog is a VIPR1 agonist, and has substantially reduced selectivity or no selectivity for VIPR2 or PAC1 receptors. In some embodiments, the composition or pharmaceutical composition of the claimed invention comprises a VIP analog, wherein the VIP analog is a PAC1 agonist, and has substantially reduced selectivity or no selectivity for VIPR2 or VIPR1 receptors. In some embodiments, the composition or pharmaceutical composition of the claimed invention comprises a VIP analog, wherein the VIP analog is a VIPR2 agonist, and has substantially reduced selectivity or no selectivity for VIPR1 or PAC1 receptors. In some embodiments, the composition or pharmaceutical composition of the claimed invention comprises a VIP analog, wherein the VIP analog is a VIPR2 antagonist, but does not antagonize VIPR1 or PAC1 receptors. In some embodiments, the composition or pharmaceutical composition of the claimed invention comprises a VIP analog, wherein the VIP analog is a VIPR1 antagonist, but does not antagonize VIPR2 or PAC1 receptors. In some embodiments, the composition or pharmaceutical composition of the claimed invention comprises a VIP analog, wherein the VIP analog is a PAC1 antagonist, but does not antagonize VIPR2 or VIPR1 receptors. Any of the above-mentioned selective agonist or antagonists may be used in any of the method claims provided herein.

The present invention relates to modulating the amount of PLD in the nervous system of a subject comprising administering a composition comprising an analog to a subject, wherein said analog comprises an α-amino acid and at least one β-amino acid. In some embodiments the analog is a secretin family analog. In some embodiments the analog is a VIP analog.

The present invention relates to modulating the amount of antibody production of a B cell in a subject comprising administering a composition comprising an analog to a subject, wherein said analog comprises an α-amino acid and at least one β-amino acid. In some embodiments the analog is a secretin family analog. In some embodiments the analog is a VIP analog.

The present invention relates to modulating the amount of antibody production of a B cell or a B cell hybridoma cell in vitro comprising treating a culture containing B cells or a hyvridoma with a composition comprising an analog to a subject, wherein said analog comprises an α-amino acid and at least one β-amino acid. In some embodiments the analog is a secretin family analog. In some embodiments the analog is a VIP analog.

The present invention relates to modulating the immune response of a subject comprising administering a subject with a composition comprising an analog to a subject, wherein said analog comprises an α-amino acid and at least one β-amino acid. In some embodiments the analog is a secretin family analog. In some embodiments the analog is a VIP analog.

The present invention relates to modulating the activation of cystic fibrosis transmembrane conductance regulator (CFTR) in a subject comprising administering a subject with a composition comprising an analog to a subject, wherein said analog comprises an α-amino acid and at least one β-amino acid. In some embodiments the analog is a secretin family analog. In some embodiments the analog is a VIP analog.

The present invention also relates measuring the modulation of activity of a secretin receptor molecule by measuring receptor activity comprising:

a) contacting a human secretin family receptor with a secretin family analog, wherein the analog comprises an α-amino acid and at least one β-amino acid;

b) measuring the association of the secretin family analog to the secretin receptor in the presence and absence of an unknown compound; and c) comparing the rate of association of the secretin family analog to the human secretin receptor in the presence of an unknown compound to the rate of association of the secretin analog to the human secretin receptor in the absence of an unknown compound.

The present invention also relates identifying a modulator of activity of a secretin receptor molecule by measuring receptor activity comprising:

a) contacting a human secretin family receptor with a secretin family analog, wherein said analog comprises an α-amino acid and at least one β-amino acid;

b) measuring the association of the secretin family analog to the secretin receptor in the presence and absence of an unknown compound; and c) comparing the rate of association of the secretin family analog to the human secretin receptor in the presence of an unknown compound to the rate of association of the secretin analog to the human secretin receptor in the absence of an unknown compound.

The present invention also relates to a method of measuring the modulation of activity of a human VIP receptor molecule by measuring receptor activity comprising:

a) contacting a human VIP family receptor with a VIP analog, wherein the analog comprises an α-amino acid and at least one β-amino acid;

b) measuring the association of the VIP analog to the VIP receptor in the presence and absence of an unknown compound; and c) comparing the rate of association of the VIP analog to the human VIP receptor in the presence of an unknown compound to the rate of association of the VIP analog to the human VIP receptor in the absence of an unknown compound.

The present invention also relates identifying a modulator of activity of a VIP family receptor molecule by measuring receptor activity comprising:

a) contacting a human VIP family receptor with a VIP analog, wherein said analog comprises an α-amino acid and at least one β-amino acid;

b) measuring the association of the VIP analog to the VIP receptor in the presence and absence of an unknown compound; and c) comparing the rate of association of the VIP analog to the human VIP receptor in the presence of an unknown compound to the rate of association of the VIP analog to the human VIP receptor in the absence of an unknown compound. In some embodiments, the VIP family receptor is chosen from VIPR1, VIPR2, $VPAC_1$, $VPAC_2$ or $PAC_1$.

The present invention also relates identifying a modulator of activity of a VIP family receptor molecule by measuring receptor activity comprising:

a) contacting a VIP family receptor with a VIP analog in a known concentration, wherein said analog comprises an α-amino acid and at least one β-amino acid;

b) measuring the binding affinity of the VIP analog to the VIP family receptor in the presence and absence of a compound that binds to the VIP family receptor; and c) comparing the binding affinity of the VIP analog to the VIP receptor in the presence of a compound that binds to the VIP family receptor to the binding affinity of the VIP analog to the VIP receptor in the absence of a compound that binds to the VIP family receptor. In some embodiments, the VIP family receptor is chosen from VIPR1, VIPR2, $VPAC_1$, $VPAC_2$ or $PAC_1$.

The invention also relates to the use of an analog with selectivity for VPAC1, PAC1, or VPAC2 in the preparation of a medicament for treating or preventing chronic obstructive pulmonary disease, pulmonary hypertension, primary arterial hypertension, pulmonary hypertension associated to post-ventricular septal defect, idiopathic pulmonary fibrosis, idiopathic pulmonary arterial hypertension, CREST syndrome—Calcinosis; Raynaud's disease; loss of muscle control of the Esophagus; Sclerodactyly; Telangiectasia, Acute respiratory distress, congestive heart failure, chronic obstructed pulmonary disorder, asthma, chronic obstructive pulmonary disease, sarcoidosis, small cell lung carcinoma, autoimmune disease, inflammatory disease, sepsis, Hirschsprung's Disease, sexual dysfunction, erectile dysfunction, Parkinson's disease, Alzheimer's disease, circadian rhythm dysfunction, pain, colorectal cancer, hepatocellular cancer, elevated blood glucose levels, elevated blood pressure, hyperglycemia, diabetes, insulin resistance, metabolic acidosis, obesity, Type I diabetes, Type II diabetes Multiple Sclerosis, osteoporosis, Sjogren's syndrome, pancreatitis, uveoretinitis, osteoporosis, female sexual dysfunction due to administration of a medication that causes onset of or exacerbates symptoms of pulmonary hypertension, primary arterial hypertension, pulmonary hypertension associated to post-ventricular septal defect, idiopathic pulmonary fibrosis, idiopathic pulmonary arterial hypertension, CREST syndrome—Calcinosis; Raynaud's disease; loss of muscle control of the Esophagus; Sclerodactyly; Telangiectasia, Acute respiratory distress, congestive heart failure, chronic obstructed pulmonary disorder, asthma, chronic obstructive pulmonary disease, sarcoidosis, small cell lung carcinoma, autoimmune disease, inflammatory disease, sepsis, Hirschsprung's Disease, sexual dysfunction, erectile dysfunction, Parkinson's disease, Alzheimer's disease, circadian rhythm dysfunction, pain, colorectal cancer, hepatocellular cancer, elevated blood pressure levels, elevated blood glucose levels, hyperglycemia, diabetes, insulin resistance, metabolic acidosis, obesity, Type I diabetes, Type II diabetes Multiple Sclerosis, osteoporosis, Sjogren's syndrome, pancreatitis, uveoretinitis, osteoporosis, female sexual dysfunction in a subject in need thereof. In some embodiments, the invention relates to compositions comprising a secretin family analog with selectivity for VPAC1, PAC1, or VPAC2 for treatment or prevention of chronic obstructive pulmonary disease, pulmonary hypertension, primary arterial hypertension, pulmonary hypertension associated to post-ventricular septal defect, idiopathic pulmonary fibrosis, idiopathic pulmonary arterial hypertension, CREST syndrome—Calcinosis; Raynaud's disease; loss of muscle control of the Esophagus; Sclerodactyly; Telangiectasia, Acute respiratory distress, congestive heart failure, chronic obstructed pulmonary disorder, asthma, chronic obstructive pulmonary disease, sarcoidosis, small cell lung carcinoma, autoimmune disease, inflammatory disease, sepsis, Hirschsprung's Disease, sexual dysfunction, erectile dysfunction, Parkinson's disease, Alzheimer's disease, circadian rhythm dysfunction, pain, colorectal cancer, hepatocellular cancer, elevated blood pressure levels, hyperglycemia, diabetes, insulin resistance, metabolic acidosis, obesity, Type I diabetes, Type II diabetes Multiple Sclerosis, osteoporosis, Sjogren's syndrome, pancreatitis, uveoretinitis, osteoporosis, female sexual dysfunction in a subject in need thereof.

The present invention also relates to a method of treating or preventing cancer in a subject in need thereof comprising administering a VIP analog to the subject, wherein said analog comprises an α-amino acid and at least one β-amino acid and wherein said analog is a VPAC1, VPAC2, or PAC1 receptor antagonist or agonist with increased selectivity for the VPAC1, VPAC2, or PAC1 receptor as compared to the other receptors. In some embodiments, the cancer is chosen from the following: non-small cell lung carcinoma, small cell lung carcinoma, colorectal carcinoma, breast carcinoma, gastric carcinoma, prostate carcinoma, liver carcinoma, ductal pancreatic carcinoma, bladder carcinoma, Non-Hodgkin's lymphoma, maningioma, leiomyoma, endometrial carcinoma, pheochromocytoma, paraganglioma. The present invention also relates to a method of treating or preventing inflammatory disease comprising administering a VIP analog to a subject in need thereof, wherein said analog comprises an α-amino acid and at least one β-amino acid and wherein said analog is a VPAC1, VPAC2, or PAC1 receptor antagonist or agonist with increased selectivity for the VPAC1, VPAC2, or PAC1 receptor as compared to the other receptors. In some embodiments the inflammatory disease is rheumatoid arthritis. In some embodiments, the VIP analog is administered at a therapeutically effective dose.

The present invention also relates to a method of treating or preventing cancer in a subject in need thereof comprising administering a VIP analog to the subject, wherein said analog comprises an α-amino acid and at least one β-amino acid and wherein said analog is a VPAC1 receptor antagonist with increased selectivity for the VPAC1 receptor. The present invention also relates to a method of treating or preventing inflammatory disease comprising administering a VIP analog to a subject in need thereof, wherein said analog comprises an α-amino acid and at least one β-amino acid and wherein said analog is a VPAC1 receptor antagonist with increased selectivity for the VPAC1 receptor. In some embodiments the inflammatory disease is rheumatoid arthritis. In some embodiments, the VIP analog is administered at a therapeutically effective dose.

The present invention also relates to a method of treating or preventing small cell lung carcinoma comprising administering a VIP analog to a subject in need thereof, wherein said analog comprises an α-amino acid and at least one β-amino acid and wherein said analog is a VPAC1, VPAC2, or PAC1 receptor antagonist or agonist with increased selectivity for at least one VPAC1, VPAC2, or PAC1 receptor. The present invention also relates to a method of treating or preventing inflammatory disease comprising administering a VIP analog to a subject in need thereof, wherein said analog comprises an α-amino acid and at least one β-amino acid and wherein said analog is a VPAC1, VPAC2, or PAC1 receptor antagonist or agonist with increased selectivity for at least one of the following: VPAC1, VPAC2, or PAC1 receptors. In some embodiments, the VIP analog is administered at a therapeutically effective dose.

The present invention also relates to a method of treating or preventing primary arterial hypertension (PAH) comprising administering a VIP analog to a subject in need thereof, wherein said analog comprises an α-amino acid and at least one β-amino acid and wherein said analog is a VPAC1, VPAC2, or PAC1 receptor antagonist or agonist with increased selectivity for at least one VPAC1, VPAC2, or PAC1 receptor. The present invention relates to a method of treating or preventing inflammatory disease comprising administering a VIP analog to a subject in need thereof, wherein said analog comprises an α-amino acid and at least one β-amino acid and wherein said analog is a VPAC1, VPAC2, or PAC1 receptor antagonist or agonist with increased selectivity for at least one of the following: VPAC1, VPAC2, or PAC1 receptors as compared to its selectivity for the other receptors. In some embodiments, the VIP analog is administered at a therapeutically effective dose.

The present invention also relates to a method of treating or preventing inflammatory disease comprising administering a VIP analog to a subject in need thereof, wherein said analog comprises an α-amino acid and at least one β-amino acid and wherein said analog is a VPAC1 receptor agonist with increased selectivity for the VPAC1 receptor. The present invention relates to a method of treating or preventing inflammatory disease comprising administering a VIP analog to a subject in need thereof, wherein said analog comprises an α-amino acid and at least one β-amino acid and wherein said analog is a VPAC1 receptor agonist with increased selectivity for the VPAC1 receptor. In some embodiments the inflammatory disease is rheumatoid arthritis. In some embodiments, the VIP analog is administered at a therapeutically effective dose.

The present invention also relates to a method of treating or preventing inflammatory disease comprising administering a VIP analog to a subject in need thereof, wherein said analog comprises an α-amino acid and at least one β-amino acid and wherein said analog is a VPAC2 receptor agonist with increased selectivity for the VPAC2 receptor. The present invention relates to a method of treating or preventing inflammatory disease comprising administering a VIP analog to a subject in need thereof, wherein said analog comprises an α-amino acid and at least one β-amino acid and wherein said analog is a VPAC2 receptor agonist with increased selectivity for the VPAC2 receptor. In some embodiments the inflammatory disease is rheumatoid arthritis. In some embodiments, the VIP analog is administered at a therapeutically effective dose.

The present invention also relates to a method of treating or preventing chronic obstructive pulmonary disease, pulmonary hypertension, primary arterial hypertension, pulmonary hypertension associated to post-ventricular septal defect, idiopathic pulmonary fibrosis, idiopathic pulmonary arterial hypertension comprising administering a VIP analog with selectivity for VPAC2 to a subject in need thereof, wherein said analog comprises an α-amino acid and at least one β-amino acid and wherein said analog is a VPAC2 receptor agonist with increased selectivity to VPAC2 receptor. In all methods of treatment or prevention, analogs of the present invention may be administered in therapeutically effective doses.

The present invention relates to a method of treating or preventing chronic obstructive pulmonary disease (COPD) comprising administering a VIP analog to a subject in need thereof, wherein said analog comprises an α-amino acid and at least one β-amino acid and wherein said analog is a VPAC1 receptor antagonist or agonist with increased selectivity for the VPAC1 receptor. The present invention relates to a method of treating or preventing COPD comprising administering a VIP analog to a subject in need thereof, wherein said analog comprises an α-amino acid and at least one β-amino acid and wherein said analog is a VPAC1 receptor antagonist or agonist with increased selectivity for the VPAC1 receptor. In some embodiments, the VIP analog is administered at a therapeutically effective dose via nebulizer or inhaler.

The invention also relates to a method of preventing or inhibiting activation of alveolar macrophages comprising administering a VIP analog to a subject, wherein said analog comprises an α-amino acid and at least one β-amino acid and wherein said analog is a VPAC1 receptor antagonist or agonist with increased selectivity for the VPAC1 receptor. In some embodiments, the VIP analog is administered at a therapeutically effective dose via nebulizer or inhaler.

The present invention relates to a method of treating or preventing chronic obstructive pulmonary disease (COPD) comprising administering a VIP analog to a subject in need thereof, wherein said analog comprises an α-amino acid and at least one β-amino acid and wherein said analog is a VPAC2 receptor agonist with increased selectivity for the VPAC2 receptor. The present invention relates to a method of treating or preventing COPD comprising administering a VIP analog to a subject in need thereof, wherein said analog comprises an α-amino acid and at least one β-amino acid and wherein said analog is a VPAC2 receptor agonist with increased selectivity for the VPAC2 receptor. In some embodiments, the VIP analog is administered at a therapeutically effective dose via nebulizer or inhaler. The invention relates to a method of preventing or inhibiting activation of alveolar macrophages comprising administering a VIP analog to a subject, wherein said analog comprises an α-amino acid and at least one β-amino acid and wherein said analog is a VPAC2 receptor agonist with increased selectivity for the VPAC2 receptor. In some embodiments, the VIP analog is administered at a therapeutically effective dose via nebulizer or inhaler.

The present invention also relates to methods of identifying a selective modulator of activity of a VIP family receptor molecule by measuring receptor activity comprising:

a) contacting a human VIP family receptor with a VIP analog, wherein said analog comprises an α-amino acid and at least one β-amino acid;

b) measuring the association of the VIP analog to the VIP receptor in the presence and absence of an unknown compound; and c) comparing the rate of association of the VIP analog to the human VIP receptor in the presence of an unknown compound to the rate of association of the VIP analog to the human VIP receptor in the absence of an unknown compound.

The present invention also relates to methods of identifying a selective modulator of activity of a VIP family receptor molecule by measuring receptor activity comprising:

a) contacting a first and a second VIP family receptor with a VIP analog in a known concentration, wherein said analog comprises an α-amino acid and at least one β-amino acid;

b) measuring the rate association of the VIP analog to the first and second VIP receptors in the presence and absence of an unknown compound; and c) comparing the rate of association of the VIP analog to the first VIP receptor in the presence of an unknown compound to the rate of association of the VIP analog to the second VIP receptor in the absence of an unknown compound.

The present invention also relates to methods of identifying a selective modulator of activity of a VIP family receptor molecule by measuring receptor activity comprising:

a) contacting a first and a second VIP family receptor with a VIP analog in a known concentration, wherein said analog comprises an α-amino acid and at least one β-amino acid;

b) measuring the binding affinity of the VIP analog to the first and second VIP receptors in the presence and absence of an unknown compound; and c) comparing the binding affinity of the VIP analog to the first VIP receptor in the presence of an unknown compound to the binding affinity of the VIP analog to the second VIP receptor in the absence of an unknown compound. In some embodiments, the VIP family receptor is chosen from VIPR1, VIPR2, $VPAC_1$, $VPAC_2$ or $PAC_1$.

The present invention also relates to methods of inhibiting the immune response against a transplanted organ in a subject, wherein the subject is an organ donor recipient. in some embodiments, the subject is a mammal. In some embodiments, the subject is a human. In some embodiments, the subject is a human experiencing organ rejection after transplantation.

In another embodiment, the present invention also relates to a method for inhibiting the growth of a tumor cell, the method comprising: contacting the tumor cell with an effective amount of a secretin family analog, wherein the secretin family analog or functional fragment thereof comprises at least one β-amino acid. In some embodiments, the method comprises contacting the tumor cell with an effective amount of a combination of a chemotherapeutic agent and a secretin family analog. In some embodiments, the secretin analog is a VIP analog. Suitable chemotherapeutic agents include, but are not limited to, platinum coordination compounds, topoisomerase inhibitors, antibiotics, antimitotic alkaloids and difluoronucleosides. In some embodiments, the secretin analog is a VPAC1 antagonist with selectivity for VPAC1. In some embodiments, the tumor cell is a tumor cell derived from a breast cancer, a lung cancer, a colon cancer, a prostate cancer, or a pancreatic cancer.

In another embodiment, the present invention also relates to a method of inhibiting the growth of a tumor cell in a mammalian subject in need thereof, the method comprising: administering to the subject an effective amount of a secretin family analog or functional fragment thereof, wherein the secretin family analog or functional fragment thereof comprises at least one β-amino acid. In some embodiments, the method comprises administering to the subject an effective amount of a combination of a chemotherapeutic agent and a secretin family analog. In some embodiments, the secretin analog is a VIP analog. In some embodiments, the tumor cell is a tumor cell derived from a breast cancer, a lung cancer, a colon cancer, a prostate cancer, hepatic cancer (HCC) or a pancreatic cancer. Suitable chemotherapeutic agents include, but are not limited to, platinum coordination compounds, topoisomerase inhibitors, antibiotics, antimitotic alkaloids and difluoronucleosides.

The present invention also relates to a method of treating or preventing cancer cell growth in a subject in need thereof comprising the steps of: administering a VIP analog or functional fragment thereof the subject, wherein the VIP analog or functional fragment comprises at least one β-amino acid, wherein the VIP analog or functional fragment thereof is selective or has increased selectivity to $VPAC_1$; wherein the VIP analog is a $VPAC_1$ antagonist; and wherein the cancer cell is a bladder, breast, colon, liver, lung, prostate, stomach, thyroid or uterine cancer cell. The present invention relates to a method of treating or preventing cancer in a subject in need thereof comprising the steps of: administering a VIP analog or functional fragment thereof the subject, wherein the VIP analog or functional fragment comprises at least one β-amino acid, wherein the VIP analog or functional fragment thereof is selective or has increased selectivity to $VPAC_1$; wherein the VIP analog is a $VPAC_1$ antagonist; and wherein the cancer is a bladder, breast, colon, liver, lung, prostate, stomach, thyroid, hepatocellular, or uterine cancer. In some embodiments, the cancer has been diagnosed as being malignant. In some embodiments, the subject may have an increased risk or increased susceptibility to contracting a malignant cancer.

The present invention also relates to a method of treating or preventing cancer cell growth in a subject in need thereof comprising the steps of: administering a VIP analog or functional fragment thereof the subject, wherein the VIP analog or functional fragment comprises at least one β-amino acid, wherein the VIP analog or functional fragment thereof is selective or has increased selectivity to $VPAC_2$; wherein the VIP analog is a $VPAC_2$ antagonist; and wherein the cancer cell is a lung, breast, stomach cancer cell. In some embodiments the cancer cell is derived from a stomach leiomyoma.

The present invention also relates to a method of treating or preventing cancer in a subject in need thereof comprising the steps of: administering a VIP analog or functional fragment thereof the subject, wherein the VIP analog or functional fragment comprises at least one β-amino acid, wherein the VIP analog or functional fragment thereof is selective or has increased selectivity to $VPAC_2$; wherein the VIP analog is a $VPAC_2$ antagonist; and wherein the cancer a lung, breast, stomach, or heptocellular cancer. In some embodiments, the cancer has been diagnosed as being malignant. In some embodiments, the subject may have an increased risk or increased susceptibility to contracting a malignant cancer.

The present invention also relates to a method of treating or preventing airway constriction comprising administering a VIP analog or functional fragment thereof to a subject in need thereof, wherein said analog comprises an α-amino acid and at least one β-amino acid and wherein said analog is a VPAC2 receptor agonist. In some embodiments, the VIP analog or functional fragment thereof has increased selectivity to VPAC2 receptor. In all methods of treatment or prevention, analogs of the present invention may be administered in therapeutically effective doses.

The present invention also relates to a method of treating or preventing asthma, comprising administering a VIP analog or functional fragment thereof to a subject in need thereof, wherein said analog comprises an α-amino acid and at least one β-amino acid and wherein said analog is a VPAC2 receptor agonist. In some embodiments, the VIP analog or functional fragment thereof has increased selectivity to VPAC2 receptor. In all methods of treatment or prevention, analogs of the present invention may be administered in therapeutically effective doses. In some embodiments, the VIP analog or functional fragment thereof may be administered via an inhaler or nebulizer.

The present invention also relates to a method of treating or preventing cancer cell growth in a subject in need thereof comprising the steps of: administering a VIP analog or functional fragment thereof the subject, wherein the VIP analog or functional fragment comprises at least one β-amino acid, wherein the VIP analog or functional fragment thereof is selective or has increased selectivity to $PAC_1$; wherein the VIP analog is a $PAC_1$ antagonist; and wherein the cancer cell is a nerve cell, adrenal cell, pituitary cell, or breast cell. The present invention also relates to a method of treating or preventing cancer in a subject in need thereof comprising the steps of: administering a VIP analog or functional fragment thereof the subject, wherein the VIP analog or functional fragment comprises at least one β-amino acid, wherein the VIP analog or functional fragment thereof is selective or has increased selectivity to $PAC_1$; wherein the VIP analog is a $PAC_1$ antagonist; and wherein the cancer is a glioblastoma, neuroblastoma, adrenal, pituitary, catecholamine-secreting tumors, pheochromocytomas, paragangliomas, endometrial cancers, or breast cancer. In some embodiments, the cancer has been diagnosed as being malignant. In some embodiments, the subject may have an increased risk or increased susceptibility to contracting a malignant cancer.

The invention also relates to methods of treating or preventing the aforementioned diseases using the analogs of the present invention. Any analog described in the present invention may or may not have preferred selectivity of one of its receptors versus another. The invention relates to analogs based upon the polypeptide sequences identified in Tables 1, 2, 3, and 4. All modified and unmodified variants of the sequences listed in Table 4 are contemplated as being part of the invention. For instance, the sequence of Biotin-Bombesin is listed in Table 4 as Biotin—EQRLGNQ-WAVGHLM—NH2 (SEQ ID NO:67). Not only do analogs of the claimed invention include biotinylated sequence above with an amidated methionine, but the analogs of the present invention also relate to the unmodified or modified polypeptide backbone EQRLGNQWAVGHLM as well as functional fragments thereof. In some embodiments the polypeptide analog is derived from one of the following amino acid sequences of Table 4:

TABLE 4

Targets from which the Analogs are derived

| | |
|---|---|
| 1. Galanin | 2. neurokinin A |
| 3. neurokinin B | 4. RGD |
| 5. Osteogenic growth peptide | 6. Parathyroid hormone |
| 7. Kallidin | 8. T cell receptor peptide |
| 9. PDGF | 10. Amylin |
| 11. Calcitonin | 12. GHRH |
| 13. Thymopoietin | 14. cecropin |
| 15. TRH | 16. EPO |
| 17. FGF | 18. Stem Cell Factor |
| 19. Gp120 | 20. Gp160 |
| 21. CD4 | 22. IGF |
| 23. IGF receptor | 24. Insulin |
| 25. GMCSF | 26. GCSF |
| 27. MCSF | 28. Kentsin |
| 29. LAP | 30. Tuftsin |
| 31. Prolactin | 32. Angiotensin II |
| 33. Angiotensin II receptor | 34. Dynorphin |
| 35. Calcitonin | 36. Cholecystokinin |
| 37. Pepstatin | 38. Bestatin |
| | 39. Leupeptin |
| 40. Luteinizing hormone | 41. Neurotensin |
| 42. Motilin | 43. TGF-alpha |
| 44. TGF-beta | 45. BMP-1 |
| 46. BMP-2 | 47. BMP-3 |
| 48. BMP-4 | 49. BMP-5 |
| 50. BMP-7 | 51. BMP-8 |
| 52. BMP-9 | 53. Bombesin |
| 54. Enterostatin | 55. Glucagon |
| 56. GLP-1 | 57. Beta-Endorphin |
| 58. ACTH | 59. Alpha-MSH |
| 60. γ-MSH | 61. adrenal peptide E |
| 62. alpha casein fragment | 63. beta casomorphin |
| 64. dermorphin | 65. kyotorphin |
| 66. metophamide | 67. neuropeptide FF (NPFF) |
| 68. melanocyte inhibiting factor | 69. vasotocin |
| 70. Protein kinase C | 71. Amyloid |
| 72. Amyloid fibrin | 73. Calpain |
| 74. Charybdotoxin | 75. Apamin |
| 76. Phospholipase A2 | 77. Phospholipase A2 receptor |
| 78. ENaC-alpha | 79. ENaC-beta |
| 80. ENaC-gamma | 81. IgG subunit |
| 82. Endotoxin | 83. ADNF |
| 84. Adrenomedullin | 85. Apelin |
| 86. Ghrelin | 87. Mastoparan (MCD peptides) |
| 88. Melanin concentrating hormone | 89. Nociceptin |
| 90. Nocistatin | 91. Orexin |
| 92. Receptor activity modulating protein, | 93. Urotensin |
| 94. Glycoprotein IIb/IIIa inhibitors | 95. c7E3 Fab |
| 96. Apo-lipoprotein A-I | 97. IL-1 |
| 98. IL-2 | 99. IL-3 |
| 100. IL-4 | 101. IL-5 |
| 102. IL-6 | 103. IL-7 |
| 104. IL-8 | 105. IL-9 |
| 106. IL-10 | 107. IL-12 |

TABLE 4-continued

Targets from which the Analogs are derived

| | |
|---|---|
| 108. IL-15 | 109. IL-18 |
| 110. IL-22 | 111. IL-23 |
| 112. IL-24 | 113. IL-26 |
| 114. IL-27 | 115. IL-28 |
| 116. brain-derived neurotrophic factor (BDNF) | 117. nerve growth factor |
| 118. neurotrophin 3 | 119. Corticotropin releasing factor |
| 120. MHC I bind protei | 121. P-selectin |
| 122. LFA-1 | 123. LFA-3 |
| 124. EPGF | 125. EPGF receptor |
| 126. Oxytocin | 127. Vasopressin |
| 128. Defensin, alpha 1 | 129. Neutrophil defensin 3 |
| 130. Neutrophil defensin 4 | 131. Defensin-5 |
| 132. Defesin-6 | 133. Beta-defensin I |
| 134. Beta-defensin-3 | 135. Beta defensin 103 |
| 136. Beta-defensin 107 | 137. Beta-defensin 110 |
| 138. Beta-defensin 136 | 139. RK-1 (MPCSCKKYCDPWEVIDGSCGLFNSKYICCREK) |
| 140. dermaseptin S4 | 141. magainin 1 |
| 142. magainin 2 | 143. magainin A |
| 144. magainin B | 145. magainin G |
| 146. MSI-78 | 147. MSI-99 |
| 148. MSI-130 | 149. MSI-511 |
| 150. Myp30 | 151. Pexiganan |
| 152. Laminin | 153. YIGSR |
| 154. Gastrin | 155. Gastrin releasing peptide |
| 156. GnRH | 157. Secretin |
| 158. Bradykinin | 159. Substance P |
| 160. RANTES | 161. MCP-1 |
| 162. MIP-1alpha | 163. MIP-1beta |
| 164. PDWHF | 165. CRF |
| 166. Endothelin | 167. Integrin |
| 168. Neuropeptide Y | 169. LHRH |
| 170. Enkephilin | 171. alpha-neo-endorphin, porcine |
| 172. beta-neoendorphin | 173. Ac-beta-endorphin, camel, bovine, ovine |
| 174. Ac-beta-endorphin 1-27, camel, bovine, ovine | 175. Ac-beta-endorphin, human |
| 176. Ac-beta-endorphin 1-26, human | 177. Ac-beta-endorphin 1-27, human |
| 178. Ac-gamma-endorphin (Ac-beta-lipotropin 61-77) | 179. acetyl-alpha-endorphin |
| 180. alpha-endorphin (beta-lipotropin 61-76) | 181. alpha-neo-endorphin analog |
| 182. alpha-neo-endorphin 1-7 | 183. {Arg$^8$}-alpha-neoendorphin 1-8 |
| 184. beta-endorphin (beta-lipotropin 61-91), camel, bovine, ovine | 185. beta-endorphin 1-27, camel, bovine, ovine |
| 186. beta-endorphin, equine | 187. beta-endorphin (beta-lipotropin 61-91), human |
| 188. beta-endorphin (1-5) + (16-31), human | 189. beta-endorphin 1-26, human |
| 190. beta-endorphin 1-27, human | 191. beta-endorphin 6-31, human |
| 192. beta-endorphin 18-31, human | 193. beta-endorphin, porcine |
| 194. beta-endorphin, rat | 195. beta-lipotropin 1-10, porcine |
| 196. beta-lipotropin 60-65 | 197. beta-lipotropin 61-64 |
| 198. beta-lipotropin 61-69 | 199. beta-lipotropin 88-91 |
| 200. biotinyl-beta-endorphin (biotinyl-bets-lipotropin 61-91) | 201. biocytin-beta-endorphin, human |
| 202. gamma-endorphin (beta-lipotropin 61-77) | 203. {DAla$^2$}-alpha-neo-endorphin 1-2, amide |
| 204. {DAla$^2$}-beta-lipotropin 61-69 | 205. {DAla$^2$}-gamma-endorphin |
| 206. {Des-Tyr$^1$}-beta-endorphin, human | 207. {Des-Tyr$^1$}-gamma-endorphin (beta-lipotropin 62-77) |
| 208. {Leu$^5$}-beta-endorphin, camel, bovine, ovine | 209. {Met$^5$, Lys$^6$}-alpha-neo-endorphin 1-6 |
| 210. {Met$^5$, Lys$^{6,7}$}-alpha-neo-endorphin 1-7 | 211. {Met$^5$, Lys$^6$, Arg$^7$}-alpha-neo-endorphin 1-7 |
| 212. endothelin-1 (ET-1) | 213. endothelin-1{Biotin-Lys$^9$} |
| 214. endothelin-1 (1-15), human | 215. endothelin-1 (1-15), amide, human |
| 216. Ac-endothelin-1 (16-21), human | 217. Ac-{DTrp$^{16}$}-endothelin-1 (16-21), human |
| 218. {Ala$^{3,11}$}-endothelin-1 | 219. {Dpr1, Asp$^{15}$}-endothelin-1 |
| 220. {Ala$^2$}-endothelin-3, human | 221. {Ala$^{18}$}-endothelin-1, human |
| 222. {Asn$^{18}$}-endothelin-1, human | 223 |
| 224. {Res-701-1}-endothelin B receptor antagonist | 225. Suc-{Glu$^9$, Ala$^{11,15}$}-endothelin-1 (8-21), IRL-1620 |
| 226. endothelin-C-terminal hexapeptide | 227. {D-Val$^{22}$}-big endothelin-1 (16-38), human |
| 228. endothelin-2 (ET-2), human, canine | 229. endothelin-3 (ET-3), human, rat, porcine, rabbit |
| 230. biotinyl-endothelin-3 (biotinyl-ET-3) | 231. prepro-endothelin-1 (94-109), porcine |
| 232. BQ-518 | 233. BQ-610 |
| 234. BQ-788 | 235. endothelium-dependent relaxation antagonist |
| 236. FR139317 | 237. IRL-1038 |
| 238. JKC-301 | 239. JKC-302 |
| 240. PD-145065 | 241. PD-142893 |
| 242. sarafotoxin S6a (atractaspis engaddensis) | 243. sarafotoxin S6b (atractaspis engaddensis) |

TABLE 4-continued

Targets from which the Analogs are derived 244. sarafotoxin S6c (atractaspis engaddensis)
245. {Lys$^4$}-sarafotoxin S6c
246. sarafotoxin S6d
247. big endothelin-1, human
248. biotinyl-big endothelin-1, human
249. big endothelin-1 (1-39), porcine
250. big endothelin-3 (22-41), amide, human
251. big endothelin-1 (22-39), rat
252. big endothelin-1 (1-39), bovine
253. big endothelin-1 (22-39), bovine
254. big endothelin-1 (19-38), human
255. big endothelin-1 (22-38), human
256. big endothelin-2, human
257. big endothelin-2 (22-37), human
258. big endothelin-3, human
259. big endothelin-1, porcine
260. big endothelin-1 (22-39) (prepro-endothelin-1 (74-91))
261. big endothelin-1, rat
262. big endothelin-2 (1-38), human
263. big endothelin-2 (22-38), human
264. big endothelin-3, rat
265. biotinyl-big endothelin-1, human
266. {Tyr$^{123}$}-prepro-endothelin (110-130), amide, human
267. {BQ-123}
268. {BE18257B}
269. {BE-18257A}/{W-7338A}
270. {BQ-485}
271. FR139317
272. PD-151242 and TTA-386
273. {BQ-3020} {RES-701-3} and {IRL-1720}
274. adrenorphin
275. free acid amidorphin (proenkephalin A (104-129)-NII2)
276. bovine BAM-12P
277. bovine adrenal medulla enkephalin
278. {D-Ala$^2$, D-Leu$^5$}-enkephalin
279. {D-Ala$^2$, D-Met$^5$}-enkephalin
280. {DAla$^2$}-Leu-enkephalin
281. amide {DAla$^2$, Leu$^5$, Arg$^6$}-enkephalin
282. {Des-Tyr$^1$, DPen$^{2,5}$}-enkephalin
283. {Des-Tyr$^1$, DPen$^2$, Pen$^5$}-enkephalin
284. {Des-Tyr$^1$}-Leu-enkephalin
285. {D-Pen$^{2,5}$}-enkephalin
286. {DPen$^2$, Pen$^5$}-enkephalin
287. enkephalinase substrate
288. {D-Pen$^2$, pCI-Phe$^4$, D-Pen$^5$}-enkephalin
289. Leu-enkephalin
290. amide biotinyl-Leu-enkephalin
291. {D-Ser$^2$}-Leu-enkephalin-Thr (delta-receptor peptide) (DSLET)
292. {D-Thr$^2$}-Leu-enkephalin-Thr (DTLET)
293. {Lys$^6$}-Leu-enkephalin
294. {Met$^5$, Arg$^6$}-enkephalin
295. {Met$^5$, Arg$^6$-enkephalin-Arg {Met$^5$, Arg$^6$, Phe$^7$}-enkephalin
296. amide Met-enkephalin biotinyl-Met-enkephalin
297. {D-Ala$^2$}-Met-enkephalin
298. amide Met-enkephalin-Arg-Phe Met-enkephalin
299. amide {Ala$^2$}-Met-enkephalin
300. amide {DMet$^2$, Pro$^5$}-enkephalin
301. amide {DTrp$^2$}-Met-enkephalin, amide, metorphinamide (adrenorphin) peptide B
302. bovine 3200-Dalton adrenal peptide E
303. bovine peptide F
304. bovine preproenkephalin B 186-204
305. human spinorphin
306. bovine and thiorphan (D,L,3-mercapto-2-benzylpropanoyl-glycine)
307. platelet factor-4 (58-70)
308. human echistatin (Echis carinatus) E
309. human echistatin (Echis carinatus) P
310. L selectin conserved region fibronectin
311. fibrinopeptide A
312. human {Tyr$^0$}-fibrinopeptide A
313. human fibrinopeptide B
314. human {Glu$^1$}-fibrinopeptide B
315. human {Tyr$^{15}$}-fibrinopeptide B
316. human fibrinogen beta-chain fragment of 24-42 fibrinogen binding inhibitor peptide
317. fibrinolysis inhibiting factor FN--C/H-1 (fibronectin heparin-binding fragment)
318. FN--C/H--V (fibronectin heparin-binding fragment)
319. heparin-binding peptide laminin penta peptide, amide Leu-Asp-Val-NH$_2$ (LDV-NH$_2$),
320. human, bovine, rat,
321. chicken necrofibrin
322. human necrofibrin, rat
323. platelet membrane glycoprotein IIB peptide 296-306
324. human galanin 1-19
325. human preprogalanin 1-30
326. human preprogalanin 65-88
327. human preprogalanin 89-123
328. human galanin
329. porcine galanin 1-16
330. porcine, rat galanin
331. rat biotinyl-galanin
332. rat preprogalanin 28-67
333. rat galanin 1-13-bradykinin 2-9
334. amide M40
335. galanin 1-13-Pro-Pro-(Ala-Leu) 2-Ala-amide C7
336. galanin 1-13-spantide-amide GMAP 1-41
337. amide GMAP 16-41
338. amide GMAP 25-41
339. amide galantide and entero-kassinin
340. gastrin
341. chicken gastric inhibitory peptide (GIP)
342. human gastrin I
343. human biotinyl-gastrin I
344. human big gastrin-1
345. human gastrin releasing peptide
346. human gastrin releasing peptide 1-16
347. human gastric inhibitory polypeptide (GIP)
348. porcine gastrin releasing peptide
349. porcine biotinyl-gastrin releasing peptide
350. porcine gastrin releasing peptide 14-27
351. porcine, human little gastrin TABLE 4-continued Targets from which the Analogs are derived 352. rat pentagastrin gastric inhibitory peptide 1-30
353. porcine gastric inhibitory peptide 1-30, amide
354. porcine {Tyr⁰-gastric inhibitory peptide 23-42
355. human and gastric inhibitory peptide, rat
356. {Des-His-Glu⁹}-glucagon
357. exendin-4
358. glucagon
359. human biotinyl-glucagon
360. human glucagon 19-29
361. human glucagon 22-29
362. human {Des-His¹-Glu⁹}-glucagon
363. amide glucagon-like peptide 1
364. amide glucagon-like peptide 1
365. human glucagon-like peptide 1 (7-36) glucagon-like peptide 2
366. rat biotinyl-glucagon-like peptide-1 (7-36)
367. (biofinyl-preproglucagon 78-107, amide)
368. glucagon-like peptide 2
369. human intervening peptide-2 oxyntomodulin/glucagon 37
370. valosin (peptide VQY), porcine
371. Gn-RH associated peptide 25-53
372. human Gn-RH associated peptide 1-24
373. human Gn-RH associated peptide 1-13
374. human Gn-RH associated peptide 1-13
375. rat gonadotropin releasing peptide
376. human {Tyr⁰}-GAP ({Tyr⁰}-Gn-RH Precursor Peptide 14-69)
377. proopiomelanocortin (POMC) precursor 27-52, porcine
378. TGF-d
379. TGF beta
380. TF alpha
381. TGF 34-43
382. EGF, any mammalian version
383. human acidic fibroblast growth factor basic
384. fibroblast growth factor
385. basic fibroblast growth factor 13-18
386. basic fibroblast growth factor 120-125
387. brain derived acidic fibroblast growth factor 1-11
388. brain derived basic fibroblast growth factor 1-24
389. brain derived acidic fibroblast growth factor 102-111
390. {Cys(Acm²⁰,³¹)}-epidermal growth factor 20-31
391. epidermal growth factor receptor peptide 985-996
392. insulin-like growth factor (IGF)-I
393. chicken IGF-I
394. rat IGF-I
395. human Des (1-3) IGF-I
396. human R3 IGF-I
397. human R3 IGF-I
398. human long R3 IGF-I
399. human adjuvant peptide analog
400. anorexigenic peptide Des (1-6)
401. IGF-II
402. human R6 IGF-II
403. human IGF-I analogue IGF 1 (24-41)
404. IGF 1 (57-70)
405. IGF I (30-41)
406. IGF II IGF II (33-40)
407. {Tyr⁰}-IGF II (33-40)
408. liver cell growth factor midkine
409. midkine 60-121
410. alpha-TGF 34-43
411. human alpha-TGF 34-43
412. human alpha-TGF 34-43
413. rat nerve growth factor (NGF)
414. mouse platelet-derived growth factor
415. platelet-derived growth factor
416. transforming growth factor-α
417. human and rat transforming growth factor-I
418. growth hormone (hGH)
419. human growth hormone 1-43
420. human growth hormone 6-13
421. human growth hormone releasing factor
422. murine growth hormone releasing factor
423. bovine growth hormone releasing factor
424. porcine growth hormone releasing factor 1-29, amide
425. rat growth hormone pro-releasing factor
426. human biotinyl-growth hormone releasing factor
427. human growth hormone releasing factor 1-29, amide
428. human {D-Ala²}-growth hormone releasing factor 1-29, amide
429. human {N-Ac-Tyr¹, D-Arg²}-GRF 1-29, amide
430. {His¹, Nle²⁷}-growth hormone releasing factor 1-32, amide
431. growth hormone releasing factor 1-37
432. human growth hormone releasing factor 140
433. human growth hormone releasing factor 1-40, amide
434. human growth hormone releasing factor 30-44, amide
435. human growth hormone releasing factor
436. mouse growth hormone releasing factor
437. ovine growth hormone releasing factor
438. rat biotinyl-growth hormone releasing factor
439. rat GHRP-6 ({His¹, Lys⁶}-GHRP)
440. hexarelin (growth hormone releasing hexapeptide)
441. {D-Lys³}-GHRP-6
442. {Arg⁸}-GTP-binding protein fragment
443. Gs alpha GTP-binding protein fragment
445. G beta GTP-binding protein fragment
446. GAlpha GTP-binding protein fragment
447. Go Alpha GTP-binding protein fragment
448. Gs Alpha and GTP-binding protein fragment
449. G Alpha i2
450. guanylin
451. human guanylin
452. rat uroguanylin
453. human uroguanylin
454. inhibin
455. bovine inhibin
456. alpha-subunit 1-32

TABLE 4-continued

Targets from which the Analogs are derived 457. human {Tyr⁰}-inhibin, alpha-subunit 1-32
458. human seminal plasma inhibin-like peptide
459. human {Tyr⁰}-seminal plasma inhibin-like peptide
460. human inhibin
461. alpha-subunit 1-32
462. porcine and {Tyr⁰}-inhibin, alpha-subunit 1-32, porcine
463. human insulin
464. porcine IGF-I
465. human insulin-like growth factor II (69-84)
466. pro-insulin-like growth factor 11 (68-102)
467. human pro-insulin-like growth factor II (105-128)
468. human {Asp$^{B28}$}-insulin
469. human {Lys$^{B28}$}-insulin
470. human {Leu$^{B28}$}-insulin
471. human {Val$^{B28}$}-insulin
472. human {Ala$^{B28}$}-insulin
473. human {Asp$^{B28}$, Pro$^{B29}$}-insulin
474. human {Lys$^{B28}$, Pro$^{B29}$}-insulin
475. human {Leu$^{B28}$ Pro$^{B29}$}-insulin
476. human {Val$^{B28}$, Pro$^{B29}$}-insulin
477. human {Ala$^{B28}$, Pro$^{B29}$}-insulin
478. human {Gly$^{B21}$}-insulin
479. human {Gly$^{A21}$ Gln$^{B30}$}-insulin
480. human {Ala$^{A21}$}-insulin
481. human {Ala$^{A21}$ Gln$^{B30}$} insulin
482. human {Gln$^{B30}$}-insulin
483. human {Gln$^{B30}$}-insulin
484. human {Gly$^{A21}$ Glu$^{B30}$}-insulin
485. human {Gly$^{A21}$ Gln$^{B3}$ Glu$^{B30}$}-insulin
486. human {Gln$^{B3}$ Glu$^{B30}$}-insulin
487. human B22-B30 insulin
488. human B23-B30 insulin
489. human B25-B30 insulin
490. human B26-B30 insulin
491. human B27-B30 insulin
492. human B29-B30 insulin
493. A chain of human insulin
494. B chain of human insulin
495. interleukin-1 beta 165-181, rat
496. rat IL-8
497. laminin alpha1 (I)-CB3 435-438, rat
498. laminin binding inhibitor
499. leptin 93-105
500. human leptin 22-56, rat
501. Tyr-leptin 26-39, human
502. leptin 116-130, amide, mouse
503. leucomyosuppressin (LMS)
504. leucopyrokinin (LPK)
505. leucokinin I
506. leucokinin II
507. leucokinin III
508. leucokinin IV
509. leucokinin VI
510. leucokinin VII
511. leucokinin VIII
512. antide Gn-RH II
513. chicken luteinizing hormone-releasing hormone (LH-RH)
514. (GnRH) biotinyl-LH-RH
515. cetrorelix (D-20761)
516. {D-Ala⁶}-LH-RH
517. {Gln⁸}-LH-RH (Chicken LH-RH)
518. (DLeu⁶, Val⁷) LH-RH 1-9
519. ethyl amide {D-Lys⁶}-LH-RH
520. {D-Phe², Pro³, D-Phe⁶}-LH-RH
521. {DPhe², DAla⁶} LH-RH
522. {Des-Gly¹⁰}-LH-RH, ethyl amide
523. {D-Ala⁶, Des-Gly¹⁰}-LH-RH, ethyl amide
524. {DTrp⁶}-LH-RH, ethyl amide
525. {D-Trp⁶, Des-Gly¹⁰}-LH-RH, ethyl amide (Deslorelin)
526. {DSer(But)₆, Des-Gly¹⁰}-LH-RH, ethyl amide ethyl amide leuprolide
527. LH-RH 4-10
528. LH-RH 7-10 LH-RH
529. free acid LH-RH
530. lanprey LH-RH
531. salmon {Lys⁸}-LH-RH
532. {Trp⁷, Leu⁸} LH-RH, free acid
533. {(t-Bu)DSer⁶, (Aza)Gly¹⁰}-LH-RH free acid
534. {(t-Bu)DSer⁶, (Aza)Gly¹⁰}-LH-RH
535. mastoparan
536. mas7
537. mas8
538. mas17
539. mastoparan X
540. mast cell degranulating peptide HR-1
541. mast cell degranulating peptide HR-2
542. {Ac-Cys⁴,DPhe⁷, Cys¹⁰} alpha-MSH 4-13
543. amide alpha-melanocyte stimulating hormone alpha-MSH
544. free acid beta-MSH, porcine
545. biotinyl-alpha-melanocyte stimulating hormone
546. biotinyl-{Nle⁴, D-Phe⁷}
547. alpha-melanocyte stimulating hormone
548. {Des-Acetyl}-alpha-MSH {DPhe⁷}-alpha-MSH, amide
549. gamma-1-MSH, amide
550. {Lys⁰}-gamma-1-MSH, amide
551. MSH release inhibiting factor, amide
552. {Nle⁴}-alpha-MSH, amide
553. {Nle⁴, D-Phe⁷}-alpha-MSH N-Acetyl
554. {Nle⁴, DPhe⁷} alpha-MSH 4-10, amide
555. beta-MSH, human
556. gamma-MSH
557. morphiceptin (beta-casomorphin 14 amide)
558. {D-Pro⁴}-morphiceptin
559. {N—MePhe³,D-Pro⁴}-morphiceptin
560. motilin
561. canine motilin
562. porcine biotinyl-motilin
563. porcine {Leu¹³}-motilin
564. Ac-Asp-Glu achatina cardio-excitatory peptide-1 (ACEP-1) (*Achatina fulica*)
565. adipokinetic hormone (AKH) (Locust)
566. adipokinetic hormone (Heliothis zea and Manduca sexta)
567. alytesin *Tabanus atratus*
568. adipokinetic hormone (Taa-AKH)
569. adipokinetic hormone II (*Locusta migratoria*)
570. adipokinetic hormone II (*Schistocera gregaria*)
571. adipokinetic hormone III (AKH-3)
572. adipokinetic hormone G (AKH-G) (*Gryllus bimaculatus*)
573. allatotropin (AT) (*Manduca sexta*)
574. allatotropin 6-13 (*Manduca sexta*)
575. APGW amide (*Lymnaea stagnalis*)
576. buccalin TABLE 4-continued Targets from which the Analogs are derived

| | |
|---|---|
| 577. {Des-Ser$^1$}-cerebellin corazonin (American Cockroach *Periplaneta americana*) | 578. crustacean cardioactive peptide (CCAP) |
| 579. crustacean erythrophore DF2 (*Procambarus clarkii*) | 580. diazepam-binding inhibitor fragment |
| 581. human diazepam binding inhibitor fragment (ODN) | 582. eledoisin related peptide FMRF amide (molluscan cardioexcitatory neuropeptide) |
| 583. cerebellin | 584. human granuliberin R head activator neuropeptide {His$^7$}-corazonin |
| 585. stick insect hypertrehalosaemic factor II | 586. *Tabanus atratus* hypotrehalosemic hormone (Taa-HoTH) |
| 587. rat NGE (prepro-MCH 110-128) neuropeptide | 588. methiodide piperidine-4-sulphonic acid joining peptide of proopiomelanocortin |
| 589. (POMC) | 590. bovine joining peptide |
| 591. rat KSAYMRF amide (*P. redivivus*) | 592. kassinin kinetensin levitide |
| 593. litorin LUQ 81-91 (*Aplysia californica*) | 594. LUQ 83-91 (*Aplysia californica*) |
| 595. myoactive peptide I (Periplanetin CC-1) | 596. myoactive peptide II (Periplanetin CC-2) |
| 597. myomodulin neuron specific peptide | 598. neuron specific enolase 404-443 |
| 599. rat neuropeptide FF neuropeptide K | 600. porcine NEI (prepro-MCH 131-143) neuropeptide |
| 601. rat NGE (prepro-MCH 110-128) neuropeptide | 602. rat NFI (*Procambarus clarkii*) |
| 603. PBAN-1 (*Bombyx mori*) | 604. Hez-PBAN (*Heliothis zea*) |
| 605. SCPB (cardioactive peptide from aplysia) | 606. secretoneurin, rat uperolein |
| 607. urechistachykinin I | 608. urechistachykinin II |
| 609. xenopsin-related peptide I | 610. xenopsin-related peptide II |
| 611. pedal peptide (Pep) | 612. aplysia peptide F1 |
| 613. lobster, phyllomedusin | 614. polistes mastoparan |
| 615. proctolin | 616. ranatensin Ro I (Lubber Grasshopper, *Romalea microptera*) |
| 617. Ro II (Lubber Grasshopper, *Romalea microptera*) | 618. SALMF amide 1 (S1) |
| 619. SALMF amide 2 (S2) | 620. SCPA |
| 621. {Leu$^{31}$, Pro$^{34}$} neuropeptide Y, human neuropeptide F (*Moniezia expansa*) | 622. B1BP3226 NPY antagonist Bis (31/31') {{Cys$^{31}$, Trp$^{32}$, Nva$^{34}$} NPY 31-36} neuropeptide Y, human |
| 623. rat neuropeptide Y 1-24 amide | 624. human biotinyl-neuropeptide Y |
| 625. {D-Tyr$^{27,36}$, D-Thr$^{32}$}-NPY 27-36 | 626. Des 10-17 (cyclo 7-21) {Cys$^{7,21}$, Pro$^{34}$}-NPY C2-NPY |
| 627. {Leu$^{31}$, Pro$^{34}$} neuropeptide Y | 628. human neuropeptide Y |
| 629. porcine prepro NPY 68-97 | 630. human N-acetyl-{Leu$^{28}$, Leu$^{31}$} NPY 24-36 neuropeptide Y |
| 631. porcine {D-Trp$^{32}$}-neuropeptide Y | 632. porcine {D-Trp$^{32}$} NPY 1-36 |
| 633. human {Leu$^{17}$, DTrp$^{32}$} neuropeptide Y | 634. human {Leu$^{31}$, Pro$^{34}$}-NPY |
| 635. porcine NPY 2-36 | 636. porcine NPY 3-36 |
| 637. human NPY 3-36 | 638. porcine NPY 13-36 |
| 639. human NPY 13-36 | 640. porcine NPY 16-36 |
| 641. porcine NPY 18-36 | 642. porcine NPY 20-36 |
| 643. FY 22-36 NPY 26-36 | 644. Pro$^{34}$}-NPY 1-36 |
| 645. human {Pro$^{34}$}-neuropeptide Y | 646. porcine PYX-1 |
| 647. PYX-2 | 648. T4-{NPY(33-36)}4 |
| 649. Tyr(OMe)$^{21}$}-neuropeptide Y, human | 650. glial derived neurotropic factor (GDNF) |
| 651. brain derived neurotropic factor (BDNF) | 652. ciliary neurotropic factor (CNTF) |
| 653. orexin A | 654. human orexin B |
| 655. rat orexin B | 656. mouse orexin B |
| 657. alpha-casein fragment 90-95 | 658. BAM-18P |
| 659. casomokinin L | 660. casoxin D |
| 661. crystalline DALDA | 662. dermenkephalin (deltorphin) (*Phylomedusa sauvagei*) |
| 663. {D-Ala$^2$}-deltorphin I | 664. {D-Ala$^2$}-deltorphin II |
| 665. endomorphin-1 | 666. endomorphin-2 |
| 667. kyotorphin | 668. {DArg$^2$}-kyotorphin |
| 669. morphine tolerance peptide | 670. morphine modulating peptide |
| 671. C-terminal fragment morphine modulating neuropeptide (A-18-F--NH2) | 672. nociceptin {orphanin FQ} (ORL1 agonist) |
| 673. TIPP | 674. Tyr-MIF-1 |
| 675. Tyr-W-MIF-1 | 676. valorphin LW-hemorphin-6 |
| 677. human Leu-valorphin-Arg | 678. Z-Pro-D-Leu |
| 679. {Asu$^6$}-oxytocin | 680. oxytocin |
| 681. biotinyl-oxytocin | 682. {Thr$^4$, Gly$^7$}-oxytocin |
| 683. tocinoic acid ({Ile$^3$}-pressinoic acid) | 684. PACAP 1-27, human, ovine, rat |
| 685. PACAP (1-27)-Gly-Lys-Arg-NH$_2$ | 686. human {Des-Gln$^{16}$}-PACAP 6-27 |
| 687. human, ovine, rat PACAP38 | 688. frog PACAP27-NH$_2$ |

TABLE 4-continued

Targets from which the Analogs are derived

| | |
|---|---|
| 689. human, ovine, rat biotinyl-PACAP27-NH2 | 690. human, ovine, rat PACAP 6-27 |
| 691. human, ovine, rat PACAP38 | 692. human, ovine, rat biotinyl-PACAP38 |
| 693. human, ovine, rat PACAP 6-38 | 694. human, ovine, rat PACAP27-NH$_2$ |
| 695. human, ovine, rat biotinyl-PACAP27-NH$_2$ | 696. human, ovine, rat PACAP 6-27 |
| 697. human, ovine, rat PACAP38 | 698. human, ovine, rat biotinyl-PACAP38 |
| 699. human, ovine, rat PACAP 6-38 | 700. human, ovine, rat PACAP38 16-38 |
| 701. human, ovine, rat PACAP38 31-38 | 702. human, ovine, rat PACAP38 31-38 |
| 703. human, ovine, rat PACAP-related peptide (PRP) | 704. human |
| 705. PACAP-related peptide (PRP), rat | 706. chromostatin |
| 707. bovine pancreastatin (hPST-52) (chromogranin A 250-301, amide) | 708. pancreastatin 24-52 (hPST-29) |
| 709. human chromogranin A 286-301, amide | 710. human pancreastatin |
| 711. porcine biotinyl-pancreastatin | 712. porcine {Nle$^8$}-pancreastatin |
| 713. porcine {Tyr$^0$,Nle$^8$}-pancreastatin | 714. porcine {Tyr$^0$}-pancreastatin |
| 715. porcine parastatin 1-19 (chromogranin A 347-365) | 716. porcine pancreastatin |
| 717. chromogranin A 264-314-amide | 718. rat biotinyl-pancreastatin |
| 719. biotinyl-chromogranin A 264-314-amide | 720. {Tyr$^0$}-pancreastatin |
| 721. rat pancreastatin 26-51 | 722. pancreastatin 33-49, porcine |
| 723. pancreatic polypeptide | 724. avian pancreatic polypeptide |
| 725. human C-fragment pancreatic polypeptide acid | 726. human C-fragment pancreatic polypeptide amide |
| 727. human pancreatic polypeptide (Rana temporaria) | 728. ancreatic polypeptide |
| 729. salmon pancreatic polypeptide | 730. {Asp$^{76}$}-parathyroid hormone 39-84 |
| 731. human {Asp$^{76}$}-parathyroid hormone 53-84 | 732. human {Asn$^{76}$}-parathyroid hormone 1-84 |
| 733. hormone {Asn$^{76}$}-parathyroid hormone 64-84 | 734. human {Asn$^8$, Leu$^{18}$}-parathyroid hormone 1-34 |
| 735. human {Cys$^{5,28}$}-parathyroid hormone 1-34 | 736. human hypercalcemia malignancy factor 1-40 |
| 737. {Leu$^{18}$}-parathyroid hormone 1-34 | 738. human {Lys(biotinyl)}$^{13}$ |
| 739. {Nle$^{8,18}$, Tyr$^{34}$}-parathyroid hormone 1-34 amide | 740. {Nle$^{8,18}$, Tyr$^{34}$}-parathyroid hormone 3-34 amide |
| 741. bovine {Nle$^{8,18}$, Tyr$^{34}$}-parathyroid hormone 1-34 | 742. human {Nle$^{8,18}$, Tyr$^{34}$}-parathyroid hormone 1-34 amide |
| 743. human {Nle$^{8,18}$, Tyr$^{34}$}-parathyroid hormone 3-34 amide | 744. human {Nle$^{8,18}$, Tyr$^{34}$}-parathyroid hormone 7-34 amide |
| 745. bovine {Nle$^{8,21}$, Tyr$^{34}$}-parathyroid hormone 1-34 amide | 746. rat parathyroid hormone 44-68 |
| 747. human parathyroid hormone 1-34 | 748. bovine parathyroid hormone 3-34 |
| 749. bovine parathyroid hormone 1-31 amide | 750. human parathyroid hormone 1-34 |
| 751. human parathyroid hormone 13-34 | 752. human parathyroid hormone 1-34 |
| 753. rat parathyroid hormone 1-38 | 754. human parathyroid hormone 1-44 |
| 755. human parathyroid hormone 28-48 | 756. human parathyroid hormone 39-68 |
| 757. human parathyroid hormone 39-84 | 758. human parathyroid hormone 53-84 |
| 759. human parathyroid hormone 69-84 | 760. human parathyroid hormone 70-84 |
| 761. human {Pro$^{34}$}-peptide YY (PYY) | 762. human {Tyr$^0$}-hypercalcemia malignancy factor 1-40 |
| 763. {Tyr$^0$}-parathyroid hormone 1-44 | 764. human {Tyr$^0$}-parathyroid hormone 1-34 |
| 765. human {Tyr$^1$}-parathyroid hormone 1-34 | 766. human {Tyr$^{27}$}-parathyroid hormone 27-48 |
| 767. human {Tyr$^{34}$}-parathyroid hormone 7-34 amide | 768. bovine {Tyr$^{43}$}-parathyroid hormone 43-68 |
| 769. human {Tyr$^{52}$, Asn$^{76}$}-parathyroid hormone 52-84 | 770. {Tyr$^{63}$}-parathyroid hormone 63-84, human |
| 771. PTHrP ({Tyr$^{36}$}-PTHrP 1-36 amide) | 772. chicken hHCF-(1-34)--NH2 (humoral hypercalcemic factor) |
| 773. human PTH-related protein 1-34 | 774. human biotinyl-PTH-related protein 1-34 |
| 775. human {Tyr$^0$}-PTH-related protein 1-34 | 776. human {Tyr$^{34}$}-PTH-related protein 1-34 amide |
| 777. human PTH-related protein 1-37 | 778. human PTH-related protein 7-34 amide |
| 779. human PTH-related protein 38-64 amide | 780. human PTH-related protein 67-86 amide |
| 781. human PTH-related protein 107-111 | 782. human, rat, mouse PTH-related protein 107-111 free acid |
| 783. PTH-related protein 107-138 | 784. human and PTH-related protein 109-111 |
| 785. peptide T {D-Ala$^1$}-peptide T | 786. {D-Ala$^1$}-peptide T amide |
| 787. prolactin-releasing peptide 31 | 788. human prolactin-releasing peptide 20 |
| 789. human prolactin-releasing peptide 31 | 790. rat prolactin-releasing peptide 20 |
| 791. rat prolactin-releasing peptide 31 | 792. bovine prolactin-releasing peptide 20 |
| 793. human PYY 3-36 | 794. human biotinyl-PYY |

TABLE 4-continued

Targets from which the Analogs are derived

| | |
|---|---|
| 795. human PYY | 796. human {Leu$^{31}$, Pro$^{34}$}-PYY |
| 797. porcine PYY | 798. rat PYY |
| 799. acetyl | 800. angiotensinogen 1-14 |
| 801. human angiotensinogen 1-14 | 802. porcine renin substrate tetradecapeptide |
| 803. rat {Cys$^8$}-renin substrate tetradecapeptide | 804. rat (Leu$^8$)-renin substrate tetradecapeptide |
| 805. rat {Val$^8$}-renin substrate tetradecapeptide, rat. | 806. canine secretin |
| 807. chicken secretin | 808. human biotinyl-secretin |
| 809. human secretin | 810. porcine secretin |
| 811. rat secretin | 812. BIM-23027 |
| 813. biotinyl-somatostatin biotinylated cortistatin 17 | 814. human cortistatin 14 |
| 815. rat cortistatin 17 | 816. human {Tyr$^0$}-cortistatin 17 |
| 817. human cortistatin 29 | 818. rat {D-Trp$^8$}-somatostatin |
| 819. {DTrp$^8$,DCys$^{14}$}-somatostatin | 820. {DTrp$^8$,Tyr$^{11}$}-somatostatin |
| 821. {D-Trp$^{11}$}-somatostatin NTB (Naltriben) | 822. {Nle$^8$}-somatostatin 1-28 |
| 823. octreotide (SMS 201-995) | 824. prosomatostatin 1-32 |
| 825. porcine {Tyr$^0$}-somatostatin | 826. {Tyr$^0$}-somatostatin |
| 827. {Tyr$^1$}-somatostatin 28 (1-14) | 828. {Tyr$^{11}$}-somatostatin {Tyr$^0$} |
| 829. {D-Trp$^8$}-somatostatin | 830. somatostatin |
| 831. somatostatin antagonist | 832. somatostatin-25 |
| 833. somatostatin-28 | 834. somatostatin 28 (1-12) |
| 835. biotinyl-somatostatin-28 | 836. {Tyr$^0$}-somatostatin-28 |
| 837. {Leu$^8$, D-Trp$^{22}$, Tyr$^{25}$}-somatostatin-28 | 838. biotinyl-{Leu$^8$, D-Trp$^{22}$, Tyr$^{25}$}-somatostatin-28 |
| 839. somatostatin-28 (1-14) | 840. RC-160 |
| 841. G protein antagonist-2 Ac-{Arg$^6$, Sar$^9$, Met(O2)$^{11}$}-substance P 6-11 {Arg$^3$}-substance P | 842. Ac-Trp-3,5-bis(trifluoromethyl)benzyl ester Ac-{Arg$^6$, Sar$^9$, Met(O2)$^{11}$}-substance P |
| 843. 6-11 {D-Ala$^4$}-substance P | 844. 4-11 {Tyr$^6$, D-Phe$^7$, D-His$^9$}-substance P |
| 845. 6-11 (sendide) biotinyl-substance P biotinyl-NTE{Arg$^3$}-substance P | 846. {Tyr$^8$}-substance P |
| 847. {Sar$^9$, Met(O2)$^{11}$}-substance P | 848. {D-Pro$^2$, DTrp$^{7,9}$}-substance P |
| 849. {D-Pro$^4$, O-Trp$^{7,9}$}-substance P | 850. 4-11 substance P |
| 851. 4-11 {DTrp$^{2,7,9}$}-substance P | 852. {(Dehydro)Pro$^{2,4}$, Pro$^9$}-substance P |
| 853. {Dehydro-Pro$^4$}-substance P | 854. 4-11 {Glp$^5$, (Me)Phe$^8$,Sar$^9$}-substance P |
| 855. 5-11 {Glp$^5$Sar$^9$}-substance P | 856. 5-11 {Glp$^5$}-substance P |
| 857. 5-11 hepta-substance P (substance P 5-11) hexa-substance P(substance P 6-11) | 858. {MePhe$^8$,Sar$^9$}-substance P |
| 859. {Nle$^{11}$}-substance P | 860. Octa-substance P(substance P 4-11) |
| 861. {pGlu$^1$}-hexa-substance P | 862. ({pGlu$^6$})-substance P 6-11) |
| 863. {pGlu$^6$, D-Pro$^9$}-substance P | 864. {(pNO$_2$)Phe$^7$Nle$^{11}$}-substance P |
| 865. penta-substance P (substance P 7-11) | 866. {Pro$^9$}-substance P GR73632 |
| 867. substance P 7-11 | 868. {Sar$^4$}-substance P 4-11 |
| 869. {Sar$^9$}-substance P septide | 870. ({pGlu$^6$, Pro$^9$}-substance P 6-11) |
| 871. spantide I | 872. spantide II |
| 873. cod substance P | 874. trout substance P |
| 875. antagonist substance P-Gly-Lys-Arg | 876. substance P 1-4 |
| 877. substance P 1-6 | 878. substance P 1-7 |
| 879. substance P 1-9 | 880. deca-substance P (substance P 2-11) |
| 881. nona-substance P (substance P 3-11) | 882. substance P tetrapeptide (substance P 8-11) |
| 883. substance P tripeptide (substance P 9-11) | 884. substance P, free acid |
| 885. substance P methyl ester | 886. {Tyr$^8$,Nle$^{11}$} substance P |
| 887. {Ala$^5$, beta-Ala$^8$} neurokinin A | 888. 4-10 eledoisin |
| 889. locustatachykinin I (Lom-TK-I) (Locusta migratoria) | 890. locustatachykinin 11 (Lom-TK-II) (Locusta migratoria) |
| 891. neurokinin A 4-10 | 892. neurokinin A (neuromedin L, substance K) |
| 893. cod neurokinin A | 894. biotinyl-neurokinin A (biotinyl-neuromedin L, biotinyl-substance K) |
| 895. {Tyr$^0$}-neurokinin A | 896. {Tyr$^6$}-substance K |
| 897. FR64349 | 898. {Lys$^3$, Gly$^8$-(R)-gamrna-lactam-Leu$^9$}-neurokinin A 3-10 |
| 899. GR83074 | 900. GR87389 |
| 901. GR94800 | 902. {Beta-Ala$^8$}-neurokinin A 4-10 |
| 903. {Nle$^{10}$}-neurokinin A 4-10 | 904. {Trp$^7$, beta-Ala$^8$}-neurokinin A 4-10 |
| 905. neurokinin B (neuromedin K) | 906. biotinyl-neurokinin B (biotinyl-neuromedin K) |
| 907. {MePhe$^7$}-neurokinin B | 908. {Pro$^7$}-neurokinin B |
| 909. {Tyr$^0$}-neurokinin B | 910. neuromedin B |
| 911. porcine biotinyl-neuromedin B | 912. porcine neuromedin B-30 |
| 913. porcine neuromedin B-32 | 914. porcine neuromedin B |
| 915. receptor antagonist neuromedin C | 916. porcine neuromedin N |
| 917. porcine neuromedin (U-8) | 918. porcine neuromedin (U-25) |

TABLE 4-continued

Targets from which the Analogs are derived 919. porcine neuromedin U
920. rat neuropeptide-gamma (gamma-preprotachykinin 72-92)
921. PG-KII phyllolitorin
922. {Leu$^8$}-phyllolitorin (*Phyllomedusa sauvagei*)
923. physalaemin
924. physalaemin 1-11
925. scyliorhinin II, amide
926. dogfish senktide
927. selective neurokinin B receptor peptide
928. {Ser$^2$}-neuromedin C
929. beta-preprotachykinin 69-91
930. human beta-preprotachykinin 111-129
931. human tachyplesin I
932. xenopsin
933. human xenopsin 25 (xenin 25)
934. biotinyl-thyrotropin-releasing hormone
935. {Glu$^1$}-TRH
936. His-Pro-diketopiperazine
937. {3-Me-His$^2$}-TRH
938. pGlu-Gln-Pro-amide pGlu-His {Phe$^2$}-TRH
939. prepro TRH 53-74
940. prepro TRH 83-106
941. prepro-TRH 160-169
942. Ps4, TRH-potentiating peptide
943. prepro-TRH 178-199
944. thyrotropin-releasing hormone (TRH)
945. TRH, free acid
946. TRH--SH Pro
947. TRH precursor peptide
948. omega-agatoxin TK agelenin, (spider, *Agelena opulenta*)
949. apamin (honeybee, *Apis mellifera*)
950. calcicudine (CaC) (green mamba, *Dedroaspis angusticeps*)
951. calciseptine (black mamba, *Dendroaspis polylepis polylepis*)
952. charybdotoxin (ChTX) (scorpion, *Leiurus quinquestriatus* var. *hebraeus*)
953. chlorotoxin conotoxin GI (marine snail, *Conus geographus*)
954. conotoxin GS (marine snail, *Conus geographus*)
955. conotoxin MI (Marine *Conus magus*)
956. alpha-conotoxin EI, *Conus ermineus*
957. alpha-conotoxin SIA
958. alpha-conotoxin ImI alpha-conotoxin SI (cone snail, *Conus striatus*)
959. micro-conotoxin GIIIB (marine snail, *Conus geographus*)
960. omega-conotoxin GVIA (marine snail, *Conus geographus*)
961. omega-conotoxin MVIIA (*Conus magus*)
962. omega-conotoxin MVI1C (*Conus magus*)
963. omega-conotoxin SVIB, (cone snail, *Conus striatus*)
964. endotoxin inhibitor geographutoxin I (GTX-I) (.mu.-Conotoxin GIIIA)
965. iberiotoxin (IbTX) (scorpion, *Buthus tamulus*)
967. kaliotoxin 1-37 kaliotoxin (scorpion, *Androctonus mauretanicus mauretanicus*)
968. mast cell-degranulating peptide (MCD-peptide, peptide 401)
969. margatoxin (MgTX) (scorpion, *Centruriodes Margaritatus*)
970. neurotoxin NSTX-3 (Papua New Guinean spider, *Nephilia maculata*)
971. PLTX-II (spider, *Plectreurys tristes*)
972. scyllatoxin (leiurotoxin I)
973. stichodactyla sheep VIP toxin (ShK)
974. stichodactyla porcine VIP toxin (ShK)
975. stichodactyla rat VIP toxin (ShK)
976. VIP-Gly-Lys-Arg-NH$_2$ biotinyl-PHI (biotinyl-PHI-27)
977. porcine {Glp$^{16}$} VIP 16-28
978. porcine PHI (PHI-27)
979. porcine PHI (PHI-27)
980. rat PHM-27 (PHI)
981. human prepro VIP 81-122
982. human preproVIP/PHM 111-122
983. prepro VIP/PHM 156-170
984. biotinyl-PHM-27 (biotinyl-PHI)
985. human vasoactive intestinal contractor (endothelin-beta)
986. vasoactive intestinal octacosa-peptide
987. chicken vasoactive intestinal peptide
988. guinea pig biotinyl-VIP
989. human VIP peptide 1-12
990. porcine VIP peptide 1-12
991. rat VIP peptide 1-12
992. sheep VIP peptide 1-12
993. human VIP peptide 10-28
994. porcine VIP peptide 10-28
995. rat VIP peptide 10-28
996. sheep VIP peptide 10-28
997. human VIP peptide 11-28
998. porcine VIP peptide 11-28
999. rat VIP peptide 11-28
1000. sheep VIP peptide 11-28
1001. human VIP peptide 6-28
1002. porcine VIP peptide 6-28
1003. rat VIP peptide 6-28
1004. sheep VIP peptide 6-28
1005. vasoactive intestinal peptide antagonist
1006. vasoactive intestinal peptide antagonist ({Ac-Tyr$^1$, D-Phe$^2$}-GHRF 1-29 amide)
1007. vasoactive intestinal peptide receptor antagonist (4-Cl-D-Phe$^6$, Leu$^{17}$}-VIP)
1008. vasoactive intestinal peptide receptor inhibitor binding, L-8-K
1009. Ala{$^{11,22,28}$}VIP
1010. Ala{$^{2,8,9,11,19,22,24,25,27,28}$}VIP
1011. {K$^{15}$, R$^{16}$, L$^{27}$}-VIP(1-7)/GRF(8-27)
1012. Ro25-1553
1013. Ro25-1392
1014. BAY55-9837
1015. R3P65
1016. Maxadilan
1017. PG97-269
1018. PG99-465
1019. Max.d.4.
1020. M65 (Dickson & Finlayson, Pharmacology & Therapeutics, Volume 121, Issue 3, March 2009, Pages 294-316).
1021. {Asu$^{1,6}$,Arg$^8$}-vasopressin
1022. vasotocin
1023. {Asu$^{1,6}$,Arg$^8$}-vasotocin
1024. {Lys$^8$}-vasopressin
1025. {Arg$^8$}-desamino vasopressin
1026. desglycinamide
1027. {Arg$^8$}-vasopressin (AVP)

TABLE 4-continued

Targets from which the Analogs are derived

1028. {Arg$^8$}-vasopressin desglycinamide
1029. biotinyl-{Arg$^8$}-vasopressin (biotinyl-AVP)
1030. {D-Arg$^8$}-vasopressin
1031. desamino-{Arg$^8$}-vasopressin
1032. desamino-{D-Arg$^8$}-vasopressin (DDAVP)
1033. {deamino-{D-3-(3'-pyridyl-Ala)}-{Arg$^8$}-vasopressin
1034. {1-(beta-Mercapto-beta, beta-cyclopentamethylene propionic acid), 2-(O-methyl)tyrosine}-{Arg$^8$}-vasopressin
1035. vasopressin metabolite neuropeptide
1036. {pGlu$^4$, Cys$^6$} vasopressin metabolite neuropeptide
1037. {pGlu$^4$, Cys$^6$} {Lys$^8$}-deamino vasopressin desglycinamide
1038. {Lys$^8$}-vasopressin
1039. {Mpr$^1$,Val$^4$,DArg$^8$}-vasopressin
1040. {Phe$^2$, Ile$^3$, Orn$^8$}-vasopressin
1041. ({Phe$^2$, Orn$^8$}-vasotocin)
1042. {Arg$^8$}-vasotocin
1043. {d(CH$_2$)$_5$, Tyr(Me)$_2$, Orn$^8$}-vasotocin
1044. human CMV protease substrate
1045. HCV core protein 59-68
1046. HCV NS4A
1047. protein 1840 (JT strain)
1048. HCV NS4A protein 21-34 (JT strain)
1049. hepatitis B virus receptor binding fragment
1050. hepatitis B virus pre-S region 120-145
1051. {Ala$^{127}$}-hepatitis B virus pre-S region 120-131
1052. herpes virus inhibitor 2
1053. HIV envelope protein fragment 254-274
1054. HIV gag fragment 129-135
1055. HIV substrate P 18 peptide
1056. peptide T
1057. {3,5 diiodo-Tyr$^7$} peptide T
1058. R15K
1059. HIV-1 inhibitory peptide T20
1060. T21
1061. V3
1062. decapeptide P 18-110
1063. virus replication inhibiting peptide
1064. buforin I
1065. buforin II
1066. cecropin A
1067. cecropin B
1068. cecropin P1
1069. porcine gaegurin 2 (Rana rugosa)
1070. gaegurin 5 (Rana rugosa)
1071. indolicidin
1072. protegrin-(PG)-I
1073. magainin 1
1074. magainin 2
1075. T-22
1076. {Tyr$^{5,12}$, Lys$^7$}-poly-phemusin II peptide
1077. Alzheimer's disease beta-protein (SP28)
1078. calpain inhibitor peptide
1079. capsase-1 inhibitor V
1080. capsase-3
1081. substrate IV caspase-1 inhibitor I
1082. cell-permeable caspase-1 inhibitor VI
1083. caspase-3 substrate III
1084. caspase-1 substrate V
1085. fluorogenic caspase-3 inhibitor I
1086. cell-permeable caspase-6
1087. ICE inhibitor III
1088. {Des-Ac, biotin}-ICE inhibitor III
1089. IL-1B converting enzyme (ICE) inhibitor II
1090. IL-1 B converting enzyme (ICE) substrate IV
1091. MDL 28170
1092. MG-132
1093. alpha-ANP (alpha-chANP)
1094. chicken anantin ANP 1-11
1095. rat ANP 8-30
1096. frog ANP 11-30
1097. frog ANP-21 (fANP-21)
1098. frog ANP-24 (fANP-24)
1099. frog ANP-30
1100. frog ANP fragment 5-28
1101. human ANP 7-23
1102. canine ANP 7-23
1103. human ANP fragment 7-28
1104. human alpha-atrial natriuretic polypeptide 1-28
1105. canine alpha-atrial natriuretic polypeptide 1-28
1106. human A71915
1107. canine A71915
1108. rat atrial natriuretic factor 8-33
1109. rat atrial natriuretic polypeptide 3-28
1110. human atrial natriuretic polypeptide 4-28
1111. human atrial natriuretic polypeptide 5-27
1112. canine atrial natriuretic polypeptide 5-27
1113. human atrial natriuretic aeptide (ANP)
1114. eel atriopeptin I
1115. rat atriopeptin II
1116. rabbit atriopeptin II
1117. mouse atriopeptin II
1118. rat atriopeptin III
1119. rabbit atriopeptin III
1120. mouse atriopeptin III
1121. rat atrial natriuretic factor (rANF),
1122. rabbit atrial natriuretic factor (rANF),
1123. mouse atrial natriuretic factor (rANF),
1124. rat, auriculin A (rat ANF 126-149)
1125. auriculin B (rat ANF 126-150)
1126. beta-ANP (1-28, dimer, antiparallel) beta-rANF 17-48
1127. biotinyl-alpha-ANP 1-28
1128. human biotinyl-atrial natriuretic factor (biotinyl-rANF)
1129. canine biotinyl-atrial natriuretic factor (biotinyl-rANF)
1130. rat cardiodilatin 1-16
1131. human C-ANF 4-23
1132. rat Des-{Cys$^{105}$, Cys$^{121}$}-atrial natriuretic factor 104-126
1133. rat {Met(O)$^{12}$} ANP 1-28
1134. human {Mpr$^7$,DAla$^9$}ANP 7-28, amide
1135. rat prepro-ANF 104-116
1136. human prepro-ANF 26-55 (proANF 1-30)
1137. human prepro-ANF 56-92 (proANF 31-67)
1138. human prepro-ANF 104-123
1139. human {Tyr$^0$}-atriopeptin I
1140. rat {Tyr$^0$}-atriopeptin II
1141. rabbit {Tyr$^0$}-atriopeptin II
1142. mouse {Tyr$^0$}-atriopeptin II
1143. rat {Tyr$^0$-prepro ANF 104-123}

TABLE 4-continued

Targets from which the Analogs are derived 1144. rabbit {Tyr$^0$-prepro ANF 104-123}
1145. mouse {Tyr$^0$-prepro ANF 104-123}
1146. human urodilatin (CDD/ANP 95-126)
1147. ventricular natriuretic peptide (VNP), eel
1148. ventricular natriuretic peptide (VNP), rainbow trout
1149. alpha bag cell peptide
1150. alpha-bag cell peptide 1-9
1151. alpha-bag cell peptide 1-8
1152. alpha-bag cell peptide 1-7
1153. beta-bag cell factor
1154. gamma-bag cell factor
1155. alpha-s1
1156. casein 101-123 (bovine milk)
1157. biotinyl-bombesin
1158. bombesin 8-14
1159. {Leu$^{13}$-psi (CH$_2$NH)Leu$^{14}$}-bombesin
1160. {D-Phe$^6$, Des-Met$^{14}$}-bombesin
1161. 6-14 ethylamide {DPhe$^{12}$} bombesin
1162. {DPhe$^{12}$,Leu$^{14}$}-bombesin
1163. {Tyr$^4$}-bombesin
1164. {Tyr$^4$,DPhe$^{12}$}-bombesin
1165. bone GLA protein
1166. bone GLA protein 45-49
1167. {Glu$^{17}$, Gla$^{21,24}$}-osteocalcin 1-49
1168. human myclopeptide-2 (MP-2)
1169. osteocalcin 1-49
1170. human osteocalcin 37-49
1171. {Tyr$^{38}$, Phe$^{42,46}$} bone GLA protein 38-49

1172. {Ala$^{2,6}$, des-Pro$^3$}-bradykinin
1173. bradykinin bradykinin (Bowfin. Gar)
1174. bradykinin potentiating peptide
1175. bradykinin 1-3
1176. bradykinin 1-5
1177. bradykinin 1-6
1178. bradykinin 1-7
1179. bradykinin 2-7
1180. bradykinin 2-9
1181. {DPhe$^7$} bradykinin
1182. {Des-Arg$^9$}-bradykinin
1183. {Des-Arg$^{10}$}-Lys-bradykinin
1184. ({Des-Arg$^{10}$-kallidin)
1185. {D-N—Me-Phe$^7$}-bradykinin
1186. {Des-Arg$^9$, Leu$^8$}-bradykinin
1187. Lys-bradykinin (kallidin)
1188. Lys-(Des-Arg$^9$, Leu$^8$)-bradykinin
1189. ({Des-Arg$^{10}$, Leu$^9$}-kallidin)
1190. {Lys$^0$-Hyp$^3$}-bradykinin
1191. ovokinin
1192. {Lys$^0$, Ala$^3$}-bradykinin
1193. Met-Lys-bradykinin
1194. peptide K12
1195. bradykinin potentiating peptide
1196. {(pCl)Phe$^{5,8}$}-bradykinin
1197. T-kinin (Ile-Ser-bradykinin)
1198. {Thi.$^{5,5}$, D-Phe$^7$}-bradykinin
1199. {Tyr$^0$}-bradykinin {Tyr$^5$}-bradykinin
1200. {Tyr$^8$}-bradykinin
1201. kallikrein
1202. BNP 32
1203. canine BNP-like Peptide
1204. eel BNP-32
1205. human BNP-45
1206. mouse BNP-26
1207. porcine BNP-32
1208. porcine biotinyl-BNP-32
1209. porcine BNP-32
1210. rat biotinyl-BNP-32
1211. rat BNP45 (BNP 51-95, 5K cardiac natriuretic peptide)
1212. human {Tyr$^0$}-BNP 1-32
1213. C-peptide
1214. human {Tyr$^0$}-C-peptide
1215. C-type natriuretic peptide
1216. chicken C-type natriuretic peptide-22 (CNP-22)
1217. porcine C-type natriuretic peptide-53 (CNP-53)
1218. rat C-type natriuretic peptide-53 (CNP-53)
1219. human C-type natriuretic peptide-53 (CNP-53)
1220. porcine C-type natriuretic peptide-53
1221. rat C-type natriuretic peptide-53
1222. (porcine) 1-29 (CNP-531-29)
1223. (rat) 1-29 (CNP-531-29)
1224. prepro-CNP 1-27
1225. rat prepro-CNP 30-50
1226. porcine vasonatrin peptide (VNP)
1227. rat vasonatrin peptide (VNP)
1228. {Tyr$^0$}-C-type natriuretic peptide-22 ({Tyr$^0$}-CNP-22)
1229. biotinyl-calcitonin
1230. human biotinyl-calcitonin
1231. rat biotinyl-calcitonin
1232. salmon calcitonin
1233. chicken calcitonin
1234. eel calcitonin
1235. human calcitonin
1236. porcine calcitonin
1237. rat calcitonin
1238. salmon calcitonin 1-7
1239. human calcitonin 8-32
1240. salmon katacalcin (PDN-21) (C-procalcitonin)
1241. human N-proCT (amino-terminal procalcitonin cleavage peptide)
1242. acetyl-alpha-CGRP 19-37
1243. human alpha-CGRP 19-37
1244. human alpha-CGRP 23-37
1245. human biotinyl-CGRP
1246. human biotinyl-CGRP II
1247. human biotinyl-CGRP
1248. rat beta-CGRP
1249. rat biotinyl-beta-CGRP
1250. rat CGRP
1251. human calcitonin C-terminal adjacent peptide CGRP 1-19
1252. human CGRP 20-37
1253. human CGRP 8-37
1254. human CGRP II
1255. human CGRP
1256. rat CGRP 8-37
1257. rat CGRP 29-37
1258. rat CGRP 30-37
1259. rat CGRP 31-37
1260. rat CGRP 32-37
1261. rat CGRP 33-37
1262. rat CGRP 31-37
1263. rat ({Cys(Acm)$^{2,7}$}-CGRP elcatonin
1264. {Tyr$^0$}-CGRP, human {Tyr$^0$}-CGRP II
1265. human {Tyr$^0$}-CGRP 28-37
1266. rat {Tyr$^0$}-CGRP
1267. {Tyr$^{22}$}-CGRP 22-37, rat
1268. human CART 55-102
1269. human CART
1270. rat CART 55-102
1271. beta-casomorphin
1272. human beta-casomorphin 1-3
1273. beta-casomorphin 1-3, amide
1274. beta-casomorphin, bovine
1275. beta-casomorphin 1-4
1276. bovine beta-casomorphin 1-5
1277. bovine beta-casomorphin 1-5, amide TABLE 4-continued Targets from which the Analogs are derived 1278. bovine beta-casomorphin 1-6
1279. bovine {DAla$^2$}-beta-casomorphin 1-3, amide
1280. bovine {DAla$^2$,Hyp$^4$,Tyr$^5$}-beta-casomorphin 1-5 amide
1281. {DAla$^2$,DPro$^4$,Tyr$^5$}-beta-casomorphin 1-5, amide
1282. {DAla$^2$,Tyr$^5$}-beta-casomorphin 1-5, amide
1283. bovine {DAla$^{2,4}$,Tyr$^5$}-beta-casomorphin 1-5, amide
1284. bovine {DAla$^2$, (pCl)Phe$^3$}-beta-casomorphin, amide
1285. bovine {DAla$^2$}-beta-casomorphin 1-4, amide
1286. bovine {DAla$^2$}-beta-casomorphin 1-5
1287. bovine {DAla$^2$}-beta-casomorphin 1-5, amide
1288. bovine {DAla$^2$,Met$^5$}-beta-casomorphin 1-5
1289. bovine {DPro$^2$}-beta-casomorphin 1-5, amide
1290. bovine {DAla$^2$}-beta-casomorphin 1-6
1291. bovine {DPro$^2$}-beta-casomorphin 1-4, amide
1292. {Des-Tyr$^1$}-beta-casomorphin
1293. bovine {DAla$^{2,4}$,Tyr$^5$}-beta-casomorphin 1-5, amide
1294. bovine {DAla$^2$, (pCl)Phe$^3$}-beta-casomorphin, amide
1295. bovine {DAla$^2$}-beta-casomorphin 1-4, amide
1296. bovine {DAla$^2$}-beta-casomorphin 1-5
1297. bovine {DAla$^2$}-beta-casomorphin 1-5, amide
1298. bovine {DAla$^2$,Met$^5$}-beta-casomorphin 1-5
1299. bovine {DPro$^2$}-beta-casomorphin 1-5, amide
1300. bovine {DAla$^2$}-beta-casomorphin 1-6
1301. bovine {DPro$^2$}-beta-casomorphin 14, amide
1302. {Des-Tyr$^1$}-beta-casomorphin
1303. bovine {Val$^3$}-beta-casomorphin 1-4, amide
1304. defensin 1 (human)
1305. HNP-1 (human neutrophil peptide-1)
1306. N-formyl-Met-Leu-Phe
1307. caerulein
1308. cholecystokinin
1309. cholecystokinin-pancreozymin CCK-33
1310. human cholecystokinin octapeptide 14 (non-sulfated) (CCK 26-29, unsulfated)
1311. cholecystokinin octapeptide (CCK 26-33)
1312. cholecystokinin octapeptide (non-sulfated) (CCK 26-33, unsulfated)
1313. cholecystokinin heptapeptide (CCK 27-33)
1314. cholecystokinin tetrapeptide (CCK 30-33) CCK-33
1315. porcine CR 1409
1316. cholecystokinin antagonist CCK flanking peptide (unsulfated)
1317. N-acetyl cholecystokinin, CCK 26-30
1318. sulfated N-acetyl cholecystokinin, CCK 26-31
1319. sulfated N-acetyl cholecystokinin, CCK 26-31
1320. non-sulfated prepro CCK fragment V-9-M
1321. proglumide
1322. colony-stimulating factor (CSF)
1323. GMCSF
1324. MCSF
1325. G-CSF
1326. astressin alpha-helical CRF 12-41
1327. biotinyl-CRF
1328. ovine biotinyl-CRF
1329. porcine CRF
1330. human CRF
1331. rat CRF
1332. bovine CRF
1333. ovine CRF
1334. porcine {Cys$^{21}$}-CRF
1335. CRF antagonist human (alpha-helical CRF 9-41)
1336. CRF antagonist rat (alpha-helical CRF 9-41)
1337. CRF 6-33
1338. human {DPro$^5$}-CRF
1339. rat {DPro$^5$}-CRF
1340. human {D-Phe$^{12}$, Nle$^{21,38}$}-CRF 12-41
1341. rat {D-Phe$^{12}$, Nle$^{21,38}$}-CRF 12-41
1342. human eosinophilotactic peptide {Met(0)$^{21}$}-CRF
1343. rat eosinophilotactic peptide {Met(0)$^{21}$}-CRF
1344. ovine {Nle$^{21}$,Tyr$^{32}$}-CRF
1345. ovine prepro CRF 125-151
1346. human sauvagine
1347. frog {Tyr$^0$}-CRF
1348. human {Tyr$^0$}-CRF
1349. rat {Tyr$^0$}-CRF
1350. ovine {Tyr$^0$}-CRF 34-41
1351. ovine {Tyr$^0$}-urocortin urocortin amide
1352. human urocortin
1353. rat urotensin I (Catostomus commersoni)
1354. urotensin II
1355. urotensin II (Rana ridibunda
1356. cortistatin 29
1357. cortistatin 29 (1-13)
1358. {Tyr$^0$}-cortistatin 29
1359. pro-cortistatin 28-47
1360. pro-cortistatin 51-81
1361. tumor necrosis factor
1362. TNF-β
1363. dermorphin
1364. dermorphin analog 1-4
1365. big dynorphin (prodynorphin 209-240)
1366. porcine biotinyl-dynorphin A (biotinyl-prodynorphin 209-225)
1367. {DAla$^2$, DArg$^6$}dynorphin A 1-13
1368. porcine {D-Ala$^2$}-dynorphin A
1369. porcine {D-Ala$^2$}-dynorphin A amide
1370. porcine {D-Ala$^2$}-dynorphin A 1-13, amide
1371. porcine {D-Ala$^2$}-dynorphin A 1-9
1372. porcine {DArg$^6$}-dynorphin A 1-13
1373. porcine {DArg$^8$}-dynorphin A 1-13
1374. porcine {Des-Tyr$^1$}-dynorphin A 1-8
1375. {D-Pro$^{10}$}-dynorphin A 1-11
1376. porcine dynorphin A amide
1377. porcine dynorphin A 1-6
1378. porcine dynorphin A 1-7
1379. porcine dynorphin A 1-8
1380. porcine dynorphin A 1-9
1381. porcine dynorphin A 1-10

TABLE 4-continued

Targets from which the Analogs are derived 1382. porcine dynorphin A 1-10 amide
1383. porcine dynorphin A 1-11
1384. porcine dynorphin A 1-12
1385. porcine dynorphin A 1-13
1386. porcine dynorphin A 1-13 amide
1387. porcine DAKLI (dynorphin A-analogue kappa ligand)
1388. DAKLI-biotin
1389. ({Arg$^{11,13}$}-dynorphin A (1-13)-Gly-NH(CH$_2$)$_5$NH-biotin) dynorphin A 2-17
1390. porcine dynorphin 2-17, amide
1391. porcine dynorphin A 2-12
1392. porcine dynorphin A 3-17, amide
1393. porcine dynorphin A 3-8
1394. porcine dynorphin A 3-13
1395. porcine dynorphin A 3-17
1396. porcine dynorphin A 7-17
1397. porcine dynorphin A 8-17
1398. porcine dynorphin A 6-17
1399. porcine dynorphin A 13-17
1400. porcine dynorphin A (prodynorphin 209-225)
1401. porcine dynorphin B 1-9
1402. {MeTyr$^1$, MeArg$^7$, D-Leu$^8$}-dynorphin 1-8 ethyl amide {(nMe)Tyr$^1$} dynorphin A 1-13, 1403. amide
1404. porcine {Phe$^7$}-dynorphin A 1-7
1405. porcine {Phe$^7$}-dynorphin A 1-7, amide
1406. prodynorphin 228-256 (dynorphin B 29) (leumorphin)
1407. human ACTH 1-10
1408. ACTH 1-13
1409. human ACTH 1-16
1410. human ACTH 1-17
1411. ACTH 1-24
1412. human ACTH 4-10
1413. ACTH 4-11
1414. ACTH 6-24
1415. ACTH 7-38
1416. human ACTH 18-39
1417. human ACTH
1418. rat ACTH 12-39
1419. rat beta-cell tropin (ACTH 22-39)
1420. biotinyl-ACTH 1-24
1421. human biotinyl-ACTH 7-38
1422. human corticostatin
1423. rabbit {Met(02)$^4$, DLys$^8$, Phe$^9$} ACTH 4-9
1424. human {Met(0)$^4$, DLys$^8$, Phe$^9$} ACTH 4-9
1425. human N-acetyl, ACTH 1-17
1426. ebiratide
1427. adrenomedullin
1428. adrenomedullin 1-52
1429. human adrenomedullin 1-12
1430. human adrenomedullin 13-52
1431. human adrenomedullin 22-52
1432. human pro-adrenomedullin 45-92
1433. human pro-adrenomedullin 153-185
1434. human adrenomedullin 1-52
1435. porcine pro-adrenomedullin (N-20)
1436. porcine adrenomedullin 1-50
1437. rat adrenomedullin 11-50
1438. rat proAM-N20 (proadrenomedullin N-terminal 20 peptide
1439. allatostatin I
1440. allatostatin II
1441. allatostatin III
1442. allatostatin IV
1443. acetyl-amylin 8-37
1444. human acetylated amylin 8-37
1445. rat AC187 amylin antagonist AC253
1446. amylin antagonist AC625
1447. amylin antagonist amylin 8-37
1448. human amylin (IAPP)
1449. cat amylin (insulinoma or islet amyloid polypeptide(IAPP)) amylin amide
1450. human amylin 1-13 (diabetes-associated peptide 1-13)
1451. human amylin 20-29 (IAPP 20-29)
1452. human AC625 amylin antagonist
1453. amylin 8-37
1454. human amylin (IAPP)
1455. cat amylin
1456. rat amylin 8-37
1457. rat biotinyl-amylin
1458. rat biotinyl-amylin amide
1459. human biotinyl-amylin amide
1460. Alzheimer's disease beta-protein 12-28 (SP17)
1461. amyloid beta-protein 25-35
1462. amyloid beta/A4-protein precursor 328-332
1463. amyloid beta/A4 protein precursor (APP) 319-335
1464. amyloid beta-protein 1-43 amyloid beta-protein 1-42
1465. amyloid beta-protein 1-40
1466. amyloid beta-protein 10-20
1467. amyloid beta-protein 22-35
1468. Alzheimer's disease beta-protein (SP28)
1469. beta-amyloid peptide 1-42
1470. rat beta-amyloid peptide 1-40
1471. rat beta-amyloid 1-11
1472. beta-amyloid 31-35
1473. beta-amyloid 32-35
1474. beta-amyloid 35-25
1475. beta-amyloid/A4 protein precursor 96-110
1476. beta-amyloid precursor protein 657-676
1477. beta-amyloid 1-38
1478. {Gln$^{11}$}-Alzheimer's disease beta-protein
1479. {Gln$^{11}$}-beta-amyloid 1-40
1480. {Gln$^{22}$}-beta-amyloid 6-40
1481. non-A beta component of Alzheimer's disease amyloid (NAC) P3, (A beta 17-40)
1482. Alzheimer's disease amyloid β-peptide
1483. SAP (serum amyloid P component) 194-204
1484. A-779 Ala-Pro-Gly-angiotensin II
1485. {Ile$^3$,Val$^5$}-angiotensin II
1486. angiotensin III
1487. antipeptide angiogenin fragment 108-122
1488. angiogenin fragment 108-123
1489. angiotensin I converting enzyme inhibitor angiotensin I
1490. human angiotensin I converting enzyme substrate angiotensin I 1-7
1491. human angiopeptin angiotensin II
1492. human angiotensin II antipeptide angiotensin II 1-4
1493. human angiotensin II 3-8
1494. human angiotensin II 4-8
1495. human angiotensin II 5-8
1496. human angiotensin III ({Des-Asp$^1$}-angiotensin II)

TABLE 4-continued

Targets from which the Analogs are derived 1497. human angiotensin III inhibitor ({Ile$^7$}-angiotensin III)
1498. angiotensin-converting enzyme inhibitor (*Neothunnus macropterus*)
1499. {Asn$^1$, Val$^5$}-angiotensin I
1500. goosefish {Asn$^1$, Val$^5$, Asn$^9$}-angiotensin I
1501. salmon {Asn$^1$, Val$^5$, Gly$^9$}-angiotensin I
1502. eel {Asn$^1$, Val$^5$}-angiotensin I 1-7
1503. eel {Asn$^1$,Val$^5$}-angiotensin II
1504. goosefish {Asn$^1$,Val$^5$}-angiotensin II
1505. salmon {Asn$^1$,Val$^5$}-angiotensin II
1506. biotinyl-angiotensin I
1507. human biotinyl-angiotensin II
1508. human biotinyl-Ala-Ala-Ala-angiotensin II
1509. {Des-Asp$^1$}-angiotensin I
1510. human {p-aminophenylalanine$^6$}-angiotensin II
1511. renin substrate (angiotensinogen 1-13)
1512. human preangiotensinogen 1-14 (renin substrate tetradecapeptide)
1513. human renin substrate tetradecapeptide (angiotensinogen 1-14)
1514. porcine {Sar$^1$}-angiotensin II
1515. {Sar$^1$}-angiotensin II 1-7 amide
1516. {Sar$^1$, Ala$^8$}-angiotensin II
1517. {Sar$^1$, Ile$^8$}-angiotensin II {Sar$^1$, Thr$^8$}-angiotensin II
1518. {Sar$^1$, Tyr(Me)$^4$}-angiotensin II (Sarmesin)
1519. {Sar$^1$, Val$^5$, Ala$^8$}-angiotensin II
1520. {Sar$^1$, Ile$^7$}-angiotensin III
1521. synthetic tetradecapeptide renin substrate (No. 2)
1522. {Val$^4$}-angiotensin III
1523. {Val$^5$}-angiotensin II
1524. {Val$^5$}-angiotensin I
1525. human {Val$^5$}-angiotensin I
1526. bullfrog {Val$^5$, Asn$^9$}-angiotensin I
1527. fowl {Val$^5$, Ser$^9$}-angiotensin I
1528. Ac-SQNY
1529. bovine bactenecin
1530. CAP 37 (20-44)
1531. carbormethoxycarbonyl-DPro-DPhe-OBzl
1532. CD36 peptide P 139-155
1533. CD36 peptide P 93-110
1534. cecropin A-melittin hybrid peptide
1535. {CA(1-7)M(2-9)NH$_2$} cecropin B, free acid
1536. CYS(Bzl)84 CD fragment 81-92
1537. defensin (human)
1538. HNP-2
1539. dermaseptin immunostimulating peptide
1540. human lactoferricin
1541. bovine lactoferricin
1542. Hepatocyte Growth Factor (HGF)
1543. HGFR α-Bag Cell Peptide (1-9)
APRLRFYSL (SEQ ID NO: 42)

γ-Bag Cell Peptide
RLRFD (SEQ ID NO: 43)

β-Bag Cell Peptide
RLRFH (SEQ ID NO: 44)

BAM 3200 Peptide E
YGGFMRRVGRPEWWMDYQKRYGGFL (SEQ ID NO: 45)

BAM-18P
YGGFMRRVGRPEWWMDYQ (SEQ ID NO: 46)

BAM-12P, Bovine Adrenal Medulla Docosapeptide
YGGFMRRVGRPE (SEQ ID NO: 47)

BAM-12P (7-12)
RVGRPE (SEQ ID NO: 48)

bFGF (119-126), Basic Fibroblast Growth Factor, human, bovine
KRTGQYKL (SEQ ID NO: 49)

bFGF Inhibitory Peptide
APSGHYKG (SEQ ID NO: 50)

bFGF Inhibitory Peptide II
MWYRPDLDERKQQRE (SEQ ID NO: 51)

{Glu63} Bax BH3, mutant
STKKLSECEKRIGDELDSNM (SEQ ID NO: 52)

BAD (103-126), human
NLWAAQRYGRELRRMSDEFVDSFK (SEQ ID NO: 53)

BAD (103-127), human
NLWAAQRYGRELRRMSDEFVDSFKK (SEQ ID NO: 54)

BAD (NT-1)
PEFEPSEQEDSSSAERC-NH2 (SEQ ID NO: 55)

TABLE 4-continued

Targets from which the Analogs are derived

Bak-BH3, TAMRA-labeled
GQVGRQLAIIGDDINR-K(TAMRA)-NH2  (SEQ ID NO: 56)

Bax BH3 peptide (55-74), wild type
STKKLSECLKRIGDELDSNM  (SEQ ID NO: 57)

Bcl 9-2
GSEGLSKEQLEHRERSLQTLRDIERLLLRSGETEPFLKGPPGGAG-NH2  (SEQ ID NO: 58)

BMf-BH3
LQHRAEVQIARKLQCIADQFHRLHT  (SEQ ID NO: 59)

Noxa BH3, Peptide 1
PAELEVECATQLRRFGDKLNFRQKLL  (SEQ ID NO: 60)

{D-Phe12, Leu14}-Bombesin
Pyr-QRLGNQWAVGfLL-NH2  (SEQ ID NO: 61)

{D-Phe12}-Bombesin
Pyr-QRLGNQWAVGfLM-NH2  (SEQ ID NO: 62)

{D-Tyr6, β-Ala11, Phe13, Nle14}-Bombesin (6-14)
yQWAV-(β-A)-HF-Nle-NH2  (SEQ ID NO: 63)

{D-Tyr6, β-Ala11, β-Phe13, Nle14}-Bombesin (1-14)
Pyr-QRLGyQWAV-(β-A)-H-(β-F)-Nle-NH2  (SEQ ID NO: 64)

{Lys3}-Bombesin
Pyr-QKLGNQWAVGHLM-NH2  (SEQ ID NO: 65)

{Tyr4, D-Phe12}-Bombesin
Pyr-QRYGNQWAVGfLM-NH2  (SEQ ID NO: 66)

{Tyr4}-Bombesin
Pyr-QRYGNQWAVGHLM-NH2  (SEQ ID NO: 66)

Biotin-Bombesin
Biotin-EQRLGNQWAVGHLM-NH2  (SEQ ID NO: 68)

Biotin-LC-LC-Bombesin
Biotin-LC-LC-EQRLGNQWAVGHLM-NH2  (SEQ ID NO: 68)

Bombesin
Pyr-QRLGNQWAVGHLM-NH2  (SEQ ID NO: 65)

Bombesin, FAM-labeled
FAM-EQRLGNQWAVGHLM-NH2  (SEQ ID NO: 68)

{D-Phe7}-Bradykinin
RPPGFSfFR  (SEQ ID NO: 69)

{Des-Arg1}-Bradykinin
PPGFSPFR  (SEQ ID NO: 70)

{Des-Arg10}-HOE 140
rRP-Hyp-G-Thi-S-(D-Tic)-Oic

{Ile-Ser}-Bradykinin (T-Kinin)
ISRPPGFSPFR  (SEQ ID NO: 71)

{Leu8, Des-Arg9}-Bradykinin
RPPGFSPL  (SEQ ID NO: 72)

{Lys0}-Bradykinin (Kallidin)
KRPPGFSPFR  (SEQ ID NO: 73)

Angiotensin Converting Enzyme Inhibitor, BPP 9a
Pyr-WPRPQIPP  (SEQ ID NO: 74)

Biotin-Bradykinin
Biotin-RPPGFSPFR  (SEQ ID NO: 75)

Bradykinin
RPPGFSPFR  (SEQ ID NO: 76)

Bradykinin Potentiator B, Angiotensin I Converting Enzyme Inhibitor
Pyr-GLPPRPKIPP  (SEQ ID NO: 77)

TABLE 4-continued

Targets from which the Analogs are derived

Bradykinin Potentiator C, Angiotensin I Converting Enzyme Inhibitor
Pyr-GLPPGPPIPP  (SEQ ID NO: 78)

Hemopressin
PVNFKLLSHHOE 140
rRP-(Hyp)-G-(Thi)-S-(D-Tic)-(Oic)-R  (SEQ ID NO: 79)

C-peptide (57-87), human
EAEDLQVGQVELGGGPGAGSLQPLALEGSLQ  (SEQ ID NO: 80)

Proinsulin C-peptide (55-89), human
RREAEDLQVGQVELGGGPGAGSLQPLALEGSLQKR  (SEQ ID NO: 81)

{Trp63, 64}-C3a (63-77)
WWGKKYRASKLGLAR  (SEQ ID NO: 82)

C3a (70-77)
ASHLGLAR  (SEQ ID NO: 83)

C3f fragment, Human c3 (1286-1297)
THRIHWESASLL  (SEQ ID NO: 84)

C3f, Human c3 (1282-1298)
SSKITHRIHWESASLLR  (SEQ ID NO: 85)

Complement anaphylatoxin C5a (37-53), human
RAARISLGPRCIKAFTE  (SEQ ID NO: 86)

α-CGRP (19-37), human
SGGVVKNNFVPTNVGSKAF-NH2  (SEQ ID NO: 87)

{Tyr0}-α-CGRP, human
YACDTATCVTHRLAGLLSRSGGVVKNNFVPTNVGSKAF-NH2 (Disulfide bridge: between
amino acids 3 and 8)  (SEQ ID NO: 88)

Biotin-Calcitonin, human
Biotin-CGNLSTCMLGTYTQDFNKFHTFPQTAIGVGAP-NH2 (Disulfide bridge: between amino
acids 1-7)  (SEQ ID NO: 89)

Calcitonin Gene Related Peptide, CGRP (8-37), human
VTHRLAGLLSRSGGVVKNNFVPTNVGSKAF-NH2  (SEQ ID NO: 90)

Calcitonin Gene Related Peptide, CGRP (8-37), rat
VTHRLAGLLSRSGGVVKDNFVPTNVGSEAF-NH2  (SEQ ID NO: 91)

Calcitonin Gene Related Peptide, CGRP, chicken
ACNTATCVTHRLADFLSRSGGVGKNNFVPTNVGSKAF-NH2 (Disulfide bridge: 2-7)  (SEQ ID NO: 92)

Calcitonin Gene Related Peptide, CGRP, human
ACDTATCVTHRLAGLLSRSGGVVKNNFVPTNVGSKAF-NH2 (Disulfide bridge: 2-7)  (SEQ ID NO: 93)

Calcitonin N-Terminal Flanking Peptide, human, N-Procalcitonin
APFRSALESSPADPATLSEDEARLLLAALVQDYVQMKASELEQEQEREGSSLDSPRS  (SEQ ID NO: 94)

Calcitonin, chicken
CASLSTCVLGKLSQELHKLQTYPRTDVGAGTP-NH2 (Disulfide bridge: 1-7)  (SEQ ID NO: 95)

Calcitonin, eel
CSNLSTCVLGKLSQELHKLQTYPRTDVGAGTP-NH2 (Disulfide bridge: 1-7)  (SEQ ID NO: 96)

Calcitonin, human
CGNLSTCMLGTYTQDFNKFHTFPQTAIGVGAP-NH2 (Disulfide bridge: 1-7)  (SEQ ID NO: 102)

Calcitonin, human, FAM-labeled
FAM-CGNLSTCMLGTYTQDFNKFHTFPQTAIGVGAP-NH2 (Disulfide bridge: 1-7)  (SEQ ID NO: 97)

Calcitonin, porcine
CSNLSTCVLSAYWRNLNNFHRFSGMGFGPETP-NH2 (Disulfide bridge: 1-7)  (SEQ ID NO: 98)

Calcitonin, rat
CGNLSTCMLGTYTQDLNKFHTFPQTSIGVGAP-NH2 (Disulfide bridge: 1-7)  (SEQ ID NO: 99)

Calcitonin, salmon
CSNLSTCVLGKLSQELHKLQTYPRTNTGSGTP-NH2 (Disulfide bridge: 1-7)  (SEQ ID NO: 100)

Calcitonin-Lys(Biotin), human
CGNLSTCMLGTYTQDFNKFHTFPQTAIGVGAPK(Biotin) (Disulfide bridge: 1-7)  (SEQ ID NO: 101)

TABLE 4-continued

Targets from which the Analogs are derived

Calcitonin-Lys(Biotin), human, FAM-labeled
FAM-CGNLSTCMLGTYTQDFNKFHTFPQTAIGVGAPK(Biotin)
(Disulfide bridge: 1-7)

{-2}pPSA, Prostate-Specific Antigen, truncated
SRIVGGWECEK (SEQ ID NO: 103)

{-4}pPSA
ILSRIVGGWECEK (SEQ ID NO: 104)

{A90,95} Bid BH3 (77-100), mouse
ESQEEIIHNIARHAAQIGAEMDHN (SEQ ID NO: 105)

{Ala6, Val15} MUC5AC Analog 2
GTTPSAVPTTSTTSVP (SEQ ID NO: 106)

{APLILSR}pPSA
APLILSRIVGGWECEK (SEQ ID NO: 107)

{Arg67}Bax H2-H3 (53-86), {R67} Helix 2-3 (53-86), mutant
DASTKKLSECLKRIRDELDSNMELQRMIAAVDTD (SEQ ID NO: 108)

{Asn370} tyrosinase (368-376)
YMNGTMSQV (SEQ ID NO: 109)

{Asp370}-Tyrosinase (368-376)
YMDGTMSQV (SEQ ID NO: 110)

{Cys(Acm)33}-Endostatin (6-49)
FQPVLHLVALNSPLSGGMRGIRGADFQ-C(Acm)-FQQARAVGLAGTFRAF (SEQ ID NO: 111)

{Gln340}-Maspin, Reactive Site Loop (RSL), (330-345)
GGDSIEVPGAQILQHK (SEQ ID NO: 112)

{Glu63} Bax BH3, mutant
STKKLSECEKRIGDELDSNM (SEQ ID NO: 57)

{Ile12, Val15} MUC5AC Analog 3
GTTPSPVPTTSITSVP (SEQ ID NO: 113)

{Ile161}MAGE-A2 (157-166)
YLQLIFGIEV (SEQ ID NO: 114)

{pSer155}-BAD BH3 (146-159)
RYGRELRRM-pS-DEFE (SEQ ID NO: 115)

{pThr145}-p21 (140-147)
RKRRQ-pT-SM (SEQ ID NO: 116)

{Ser244} Tyrosinase (240-251)
DAEKSDICTDEY (SEQ ID NO: 117)

{Val165}NY-ESO-1(157-165)
SLLMWITQV (SEQ ID NO: 118)

234 CM
KYICNSSCM (SEQ ID NO: 119)

234 CW
KYMCNSSCM (SEQ ID NO: 120)

53BP2 (490-498), p53-Binding Loop (CDB3)
REDEDEIEW (SEQ ID NO: 121)

Adipophilin
SVASTITGV (SEQ ID NO: 122)

Amphoterin (150-183)
KLKEKYEKDIAAYRAKGKPDAAKKGVVKAEKSKK (SEQ ID NO: 123)

Antennapedia Bak BH3 (Ant-BH3) (71-89) Fusion peptide
RQIKIWFQNRRMKWKKMGQVGRQLAIIGDDINRRY (SEQ ID NO: 124)

Anti-Flt1 Peptide
GNQWFI (SEQ ID NO: 1366)

TABLE 4-continued

Targets from which the Analogs are derived

Bad (103-127), human, all d-isomers
nlwaaqrygrelrrmsdefvdsfkk

BAD (CT-1)
KKGLPRPKSAGTATQMRQSSSWTC-NH2 (SEQ ID NO: 126)

BAD BH3 (103-123)
NLWAAQRYGRELRRMSDEFVD (SEQ ID NO: 127)

BAD BH3 (146-159)
RYGRELRRMSDEFE (SEQ ID NO: 128)

BAD Peptide, biotin-labeled
Biotin-LC-AGAGRSRHSSYPAGT (SEQ ID NO: 129)

BAFF-R (160-183)
SVPVPATELGSTELVTTKTAGPEQ (SEQ ID NO: 130)

BAGE (2-10)
AARAVFLAL (SEQ ID NO: 131)

Bak BH3
GQVGRQLAIIGDDINR (SEQ ID NO: 132)

Bak BH3 (67-87)
PSSTMGQVGRQLAIIGDDINR (SEQ ID NO: 133)

Bak BH3 (69-93)
STMGQVGRQLAIIGDDINRRYDSEF (SEQ ID NO: 134)

Bak BH3 (71-89)
MGQVGRQLAIIGDDINRRY (SEQ ID NO: 135)

Bak BH3 (73-87)
QVGRQLAIIGDDINR (SEQ ID NO: 136)

Bak BH3 peptide, Mca labeled
7-methoxycoumarine-4-yl acetyl (Mca)-GQVGRQLAIIGDDINR Bax BH3
KKLSECLKRIGDELDS (SEQ ID NO: 137)

Bax BH3 (58-71)
KLSECLKRIGDELD (SEQ ID NO: 138)

Bax BH3 peptide (55-74), wild type
STKKLSECLKRIGDELDSNM

Bax BH3L63A
KKLSECAKRIGDELDS (SEQ ID NO: 139)

Bax H2-H3 (53-86), Helix 2-3
DASTKKLSECLKRIGDELDSNMELQRMIAAVDTD (SEQ ID NO: 140)

Bax H3 (71-86), Helix 3 (71-86)
DSNMELQRMIAAVDTD (SEQ ID NO: 141)

Bax I
PQDASTKKLSECLKRIGDELDSNMEL (SEQ ID NO: 142)

Bcl 9-2
GSEGLSKEQLEHRERSLQTLRDIERLLLRSGETEPFLKGPPGGAG-NH2 (SEQ ID NO: 58)

Bcl-2 BH3 (85-105)
ALSPVPVVHLTLRQAGDFSRR (SEQ ID NO: 143)

Bcl-2 BH3 Peptide II
LSPVPPVVHLALRQAGDDFSRRYRG (SEQ ID NO: 144)

Bcl-2 Binding Peptide, Bad BH3 Peptide
LWAAQRYGRELRRMSDEFEGSFKGL (SEQ ID NO: 145)

Bcl-XL BH3 (85-98)
AVKQALREAGDEFE (SEQ ID NO: 146)

Bcl9-2, mutant
GSEGLSKEQLEHRERSFQTLRDIERLLLRSGETEPFLKGPPGGAG-NH2 (SEQ ID NO: 147)

TABLE 4-continued

Targets from which the Analogs are derived

BDC2.5(A)
GKKVAAPAWARMG (SEQ ID NO: 148)

BH3 BIM Peptide (52-71), human
Ac-MRPEIWIAQELRRIGDEFNA (SEQ ID NO: 149)

Bid BH3 (77-100), mouse
ESQEEIIHNIARHLAQIGDEMDHN (SEQ ID NO: 150)

Bid BH3 (79-99)
QEDIIRNIARHLAQVGDSMDR (SEQ ID NO: 151)

Bid BH3 (85-98)
NIARHLAQVGDSMD (SEQ ID NO: 152)

Bid BH3 Peptide
EDIIRNIARHLAQVGDSMDR (SEQ ID NO: 153)

Bid BH3, FAM labeled
5-FAM-EDIIRNIARHLAQVGDSMDR (SEQ ID NO: 153)

Bid BH3, Peptide II, TAMRA labeled
5-TAMRA-EDIIRNIARHLAQVGDSMDR (SEQ ID NO: 153)

Bid BH3-r8
$_dR_dR_dR_dR_dR_dR_dR_dR$-GEDIIRNIARHLAQVGDSMDR

Bid BH3-R8
RRRRRRRRGEDIIRNIARHLAQVGDSMDR (SEQ ID NO: 156)

Bid BH3-R9
RRRRRRRRRGEDIIRNIARHLAQVGDSMDR (SEQ ID NO: 157)

Bid-BH3
RNIARHLAQVGDSMDR (SEQ ID NO: 158)

Bik BH3 (50-70)

Bik BH3 (56-69)
ALALRLACIGDEMD (SEQ ID NO: 159)

BIK BH3 Peptide
MEGSDALALRLACIGDEMDV (SEQ ID NO: 160)

Bim BH3 (87-100)
WIAQELRRIGDEFN (SEQ ID NO: 161)

Bim BH3 Fragment I, TAMRA labeled
5-TAMRA-DNRPEIWIAQELRRIGDEFNAYYAR (SEQ ID NO: 162)

Bim BH3, Fragment II, TAMRA labeled
5-TAMRA-MRPEIWIAQELRRIGDEFNA (SEQ ID NO: 163)

Bim BH3, Peptide III
DMRPEIWIAQELRRIGDEFNAYYAR (SEQ ID NO: 164)

Bim BH3, Peptide IV
DMRPEIWIAQELRRIGDEFNAYYARR (SEQ ID NO: 165)

Bim-23056
fFYwKVFnal-NH2 (SEQ ID NO: 166)

BMF BH3 peptide
HQAEVQIARKLQLIADQFHR (SEQ ID NO: 167)

BNIP3-α BH3 peptide
VVEGEKEVEALKKSADWVSD (SEQ ID NO: 168)

BRCAA1 (610-619)
SSKKQKRSHK (SEQ ID NO: 169)

c-Myc peptide epitope
EQKLISEEDL (SEQ ID NO: 170)

CEA, CAP-1, Carcinoembryonic Antigen
YLSGANLNL (SEQ ID NO: 171)

TABLE 4-continued

Targets from which the Analogs are derived

CEA Related, QYSWFVNGTF
QYSWFVNGTF  (SEQ ID NO: 172)

CEA Related, TYACFVSNL
TYACFVSNL  (SEQ ID NO: 173)

CEA, CAP-1-6-D, {Asp6}-Carcinoembryonic Antigen
YLSGADLNL  (SEQ ID NO: 174)

Cell Penetrating ARF Peptide (26-44)
$_d$R $_d$R $_d$R $_d$R $_d$R $_d$R $_d$R $_d$R $_d$R KFVRSRRPRTASCALAFVN  (SEQ ID NO: 175)

Cell Penetrating Mutant ARF (37-44) Peptide
$_d$R $_d$R $_d$R $_d$R $_d$R $_d$R $_d$R $_d$R $_d$R SCALAFVN  (SEQ ID NO: 176)

Cripto-1, CR-1
CPPSFYGRNCEHDVRKE  (SEQ ID NO: 177)

CTT, Gelatinase Inhibitor
CTTHWGFTLC (Disulfide Bridge: 1-10)  (SEQ ID NO: 178)

Cys-p21 (139-154)
CGRKRRQTSMTDFYHSK  (SEQ ID NO: 179)

E7 (43-62), HPV Oncoprotein
GQAEPDRAHYNIVTFCCKCD  (SEQ ID NO: 180)

E7 (43-77), HPV Oncoprotein
GQAEPDRAHYNIVTFCCKCDSTLRLCVQSTHVDIR  (SEQ ID NO: 181)

EGFR (662-681)
RRELVEPLTPSGEAPNQALLR  (SEQ ID NO: 182)

Ep-CAM (263-271)
GLKAGVIAV  (SEQ ID NO: 183)

Epidermal Mitosis Inhibiting Pentapeptide
Pyr-EDSG  (SEQ ID NO: 184)

F4.2, Gastric Signet Ring Cell Carcinoma Derived Peptide
YSWMDISCWI  (SEQ ID NO: 185)

G154, gp100 (154-162)
KTWGQYWQV  (SEQ ID NO: 186)

G209, gp100 (209-217)
ITDQVPFSV  (SEQ ID NO: 187)

G209-2M, gp100 (209-217)
IMDQVPFSV  (SEQ ID NO: 188)

G280-9, gp100 (280-288), Lys (biotin)
YLEPGPVTA-K(Biotin)  (SEQ ID NO: 189)

G280-9V, gp100(280-288) Lys(biotin)
YLEPGPVTV-K(Biotin)  (SEQ ID NO: 190)

GAD65 (206-220)
TYEIAPVFVLLEYVT  (SEQ ID NO: 191)

GAD65 (78-97)
KPCNCPKGDVNYAFLHATDL  (SEQ ID NO: 192)

GnT-V (nt38-67)
VLPDVFIRCV  (SEQ ID NO: 193)

gp100 (177-186)
AMLGTHTMEV  (SEQ ID NO: 194)

gp100 (178-187)
MLGTHTMEV  (SEQ ID NO: 195)

gp100 (25-33), human
KVPRNQDWL  (SEQ ID NO: 196)

gp100 (457-466)
LLDGTATLRL  (SEQ ID NO: 197)

TABLE 4-continued

Targets from which the Analogs are derived gp100 (476-485)
VLYRYGSFSV (SEQ ID NO: 198)

gp100 (570-579)
SLADTNSLAV (SEQ ID NO: 199)

gp100 (614-622)
LIYRRRLMK (SEQ ID NO: 200)

gp100 (619-627)
RLMKQDFSV (SEQ ID NO: 201)

gp100 (639-647)
RLPRIFCSC (SEQ ID NO: 202)

GPC3 (144-152)
FVGEFFTDV (SEQ ID NO: 203)

GPC3 (298-306), mouse
EYILSLEEL (SEQ ID NO: 204)

GRP78 Binding Chimeric Peptide Motif
WIFPWIQL-GG-klaklakklaklak-NH2 (SEQ ID NO: 205)

hACC1 (1258-1271), phosphorylated
DSPPQ-pS-PTFPEAGH (SEQ ID NO: 206)

HB-1 (18-41)
WKSELVEVDDVYLRHSSSLTYRL (SEQ ID NO: 207)

HB-1 (26-41)
EDDVYLRHSSSLTYRL (SEQ ID NO: 208)

HER-2/Neu (654-662), GP2
IISAVVGIL (SEQ ID NO: 209)

HIP-1 {alpha} (556-574)
DLDLEMLAPYIPMDDDFQL (SEQ ID NO: 210)

HIF-2 (66-84)
SLEAQGIKADRETVAVKPT (SEQ ID NO: 211)

HPV16 E7(86-93)
TLGIVCPI (SEQ ID NO: 212)

HRK BH3 Peptide
SSAAQLTAARLKALGDELHQ (SEQ ID NO: 213)

IL-11R-alpha Binding Peptide II
CGRRAGGSC (S—S bonded) (SEQ ID NO: 214)

iLRP1, iLRP, Immature Laminin Receptor Protein (58-66)
LLLAARAIV (SEQ ID NO: 215)

iLRP2, iLRP (60-68)
LAARAIVAI (SEQ ID NO: 216)

iLRP3, iLRP(146-154)
ALCNTDSPL (SEQ ID NO: 217)

iLRP4, iLRP(7-15)
VLQMKEEDV (SEQ ID NO: 218)

IP3 peptide, (Lys)TAMRA labeled
MPRFMDYWEGLN-K(5/6-TMR) (SEQ ID NO: 219)

IP3 peptide, Acetylated and Biotinylated
Ac-MPRFMDYWEGLNK-K(Biotin) (SEQ ID NO: 220)

IP3 Truncated Peptide, Acetylated
Ac-FMDYWEGLN (SEQ ID NO: 221)

Kisspeptin-10, Metastin (45-54)
YNWNSFGLRF-NH2 (SEQ ID NO: 222)

KM-HN-1(107-116)
VFGTRIEKDL (SEQ ID NO: 223)

TABLE 4-continued

Targets from which the Analogs are derived

KM-HN-1(196-204)
NYNNFYRFL (SEQ ID NO: 224)

KM-HN-1(335-343)
HFCRKCKKL (SEQ ID NO: 225)

KM-HN-1(499-508)
EYSKECLKEF (SEQ ID NO: 226)

KM-HN-1(65-74)
SFQALRMQTL (SEQ ID NO: 227)

KM-HN-1(770-778)
EYLSLSDKI (SEQ ID NO: 228)

Laminin Peptide (CDPGYIGSR) NEW
CDPGYIGSR-NH2 (SEQ ID NO: 229)

Livin7, ML-IAP
KWFPSCQFLL (SEQ ID NO: 230)

LyP-1, Peptide 1 NEW
CGNKRTRGC (S—S Bonded) (SEQ ID NO: 231)

LyP-1, Peptide 2
CGNKRTRGC (SEQ ID NO: 232)

MAGE-1 (161-169)
EADPTGHSY (SEQ ID NO: 233)

MAGE-1 (230-238)
STAPPAHGV (SEQ ID NO: 234)

MAGE-3 (112-120)
KVAELVHFL (SEQ ID NO: 235)

MAGE-3 (114-127)
AELVHFLLLKYRAR (SEQ ID NO: 236)

MAGE-3 (121-134)
LLKYRAREPVTKAE (SEQ ID NO: 237)

MAGE-3 (161-169)
EVDPIGHLY (SEQ ID NO: 238)

MAGE-3 (271-279)
FLWGPRALV (SEQ ID NO: 239)

MAGE-A 1(96-104)
SLFRAVITK (SEQ ID NO: 240)

MAGE-A1 (237-245)
KLLTQDLVQ (SEQ ID NO: 241)

MAGE-A1 Antigen (278-286), human
KVLEYVIKV (SEQ ID NO: 242)

MAGE-A10 (183-191)
MLLVFGIDV (SEQ ID NO: 43

MAGE-A10 (254-262)
GLYDGMEHL (SEQ ID NO: 244)

MAGE-A2 (112-120)
KMVELVHFL (SEQ ID NO: 245)

MAGE-A2 (157-166)
YLQLVFGIEV (SEQ ID NO: 246)

MAGE-A3 (167-176)
MEVDPIGHLY (SEQ ID NO: 247)

MAGE-A3 (195-203)
IMPKAGLLI (SEQ ID NO: 248)

MAGE-A4 Antigen (230-239), human
GVYDGREHTV (SEQ ID NO: 249)

TABLE 4-continued

Targets from which the Analogs are derived

MAGE-C2 (336-344)
ALKDVEERV (SEQ ID NO: 250)

Malaria CSP (334-342)
YLKKIKNSL (SEQ ID NO: 251)

Maspin Reactive Site Loop (RSL), (330-345)
GGDSIEVPGARILQHK (SEQ ID NO: 252)

Melan-A/MART-1 (24-34)
AEEAAGIGILT (SEQ ID NO: 253)

Melanoma Antigen Family A 3 (196-204); MAGE-3 (196-204)
MPKAGLLII (SEQ ID NO: 254)

Melanoma Antigen Family A 8 (115-123); MAGE-8 (115-123)
KVAELVRFL (SEQ ID NO: 255)

Melanoma Antigen Family A 9B (223-231), MAGE-9B (223-231)
ALSVMGVYV (SEQ ID NO: 256)

Melanosomal Antigen II
DAEKCDKTDEY (SEQ ID NO: 257)

MUC-1 (9-17)
STAPPAHGV (SEQ ID NO: 234)

MUC1, tandem repeat fragment
PDTRPAPGSTAPPAHGVTSA (SEQ ID NO: 258)

MUC5AC 3
GT-T*-PSPVPTTSTTSAP (SEQ ID NO: 259)

MUC5AC, Analog 1
GTTPSPVPTTSTTSAP (SEQ ID NO: 260)

MUC5AC, Analog B
TTSTTSAPTTS (SEQ ID NO: 261)

MUC5AC-13
GTTPSPVPTTST-T*-SAP (SEQ ID NO: 262)

MUC5AC-3/13
GT-T*-PSPVPTTST-T*-SAP (SEQ ID NO: 263)

MUM-1 (261-269)
EEKLIVVLF (SEQ ID NO: 264)

MycC Peptide
YEQLRNSRA (SEQ ID NO: 265)

MZ2-F
YRPRPRRY (SEQ ID NO: 266)

NES Adenoviral E1A
VMLAVQEGIDL (SEQ ID NO: 267)

NES Nmd3p (491-500)
INIDELLDEL (SEQ ID NO: 268)

NES p120ctn
CSLEEELDVLVLDDEGG (SEQ ID NO: 269)

NES Topoisomerase II alpha (1054-1066)
FILEKIDGKIIIE (SEQ ID NO: 270)

Noxa A BH3 peptide
AELPPEFAAQLRKIGDKVYC (SEQ ID NO: 271)

Noxa A BH3 peptide, cell permeable
$_dR\ _dR\ _dR\ _dR\ _dR\ _dR\ _dR\ _dR$ GAELPPEFAAQLRKIGDKVYC (SEQ ID NO: 272)

NuBCP-9 A
FSRSLHSLL (SEQ ID NO: 273)

Nuclear Export Signal, NES HIV Rev
LQLPPLERLTLD (SEQ ID NO: 274)

TABLE 4-continued

Targets from which the Analogs are derived

Nuclear Export Signal, NES MAPKK
ALQKKLEELELD (SEQ ID NO: 275)

Nuclear Export Signal, NES p53
FRELNEALELKD (SEQ ID NO: 276)

NY-ESO-1 (53-62)
ASGPGGGAPR (SEQ ID NO: 277)

ORF5 fragment
PASKKTDPQK (SEQ ID NO: 278)

p21 (140-147)
RKRRQTSM (SEQ ID NO: 279)

p53 (12-20)
PPLSQETFS (SEQ ID NO: 280)

p53 (17-26)
ETFSDLWKLL (SEQ ID NO: 281)

p53 (17-26), FITC labeled
FITC-LC-ETFSDLWKLL-NH2 (SEQ ID NO: 282)

p53 (65-73)
RMPEAAPPV (SEQ ID NO: 283)

p53 Mutant Form (361-371), Pab 421
KKGQSTSRHKK-NH2 (SEQ ID NO: 284)

p53 Tumor Suppressor (361-393), human
GSRAHSSHLKSKKGQSTSRHKKLMFKTEGPDSD (SEQ ID NO: 285)

p53 Tumor Suppressor (361-393), LC-Biotin, human
Biotin-LC-GSRAHSSHLKSKKGQSTSRHKKLMFKTEGPDSD-NH2 (SEQ ID NO: 286)

p53, (12-26)
PPLSQETFSDLWKLL (SEQ ID NO: 287)

Pirh2-Derived Peptide (CDB62) (120-137)
LKCNLCLTTNLRGKHKCI (SEQ ID NO: 288)

PNC-28, MDM Binding Domain
ETFSDLWKLLKKWKMRRNQFWVKVQRG (SEQ ID NO: 289)

PRAME epitope (PRA300-309) Tumor-associated antigen
ALYVDSLFFL (SEQ ID NO: 290)

Pro-TGF-α
HADLLAVVAASQ (SEQ ID NO: 291)

Pro-TGF-α
HADLLAVVAASQ (SEQ ID NO: 292)

Prostate Vasculature Marker, biotin-labeled
SMSIARL-K(epsilon-LC-Biotin) (SEQ ID NO: 293)

Prostate-Specific Antigen, PSA propeptide
APLILSR (SEQ ID NO: 294)

PSA1(141-150)
FLTPKKLQCV (SEQ ID NO: 295)

PSA2 (146-154)
KLQCVDLHV (SEQ ID NO: 296)

Rab24 (179-199)
QVMTEDKGVDLSQKANPYFYS (SEQ ID NO: 297)

Rad51 (175-190) (CDB55)
AERYGLSGSDVLDNVA (SEQ ID NO: 298)

Rad51 (179-190)
GLSGSDVLDNVA (SEQ ID NO: 299)

RAGE derived peptide
SPSSNRIRNT (SEQ ID NO: 300)

TABLE 4-continued

Targets from which the Analogs are derived

Shepherdin (79-87)
KHSSGCAFL  (SEQ ID NO: 301)

Stromal Target Antigen
SIYYYRYGL  (SEQ ID NO: 302)

STT Gelatinase Inhibitor modification, negative control
STTHWGFTLS  (SEQ ID NO: 303)

Survivin
ELTLGEFLKL  (SEQ ID NO: 304)

Survivin (85-93)
AFLSVKKQF  (SEQ ID NO: 305)

Survivin 2B (80-88)
AYACNTSTL  (SEQ ID NO: 306)

Telomerase Reverse Transcriptase p572Y (TERT572Y)
RLFFYRKSV  (SEQ ID NO: 307)

TP53 Q9NP68, p53 Mutant Form (361-377), Lys371 (Ac)
KKGQSTSRHK-K(Ac)-LMFKTEG  (SEQ ID NO: 308)

TRP-1, Fragment
MSLQRQFL  (SEQ ID NO: 309)

TRP-2 (180-188) NEW
SVYDFFVWL  (SEQ ID NO: 310)

TRP-2 coding region fragment
LLPGGRPYR  (SEQ ID NO: 310)

Tumor Necrosis Factor-a Converting Enzyme, TACE (807-823), human
ASFKLQRQNRVDSKETE  (SEQ ID NO: 312)

Tyrosinase (146-156)
SSDYVIPIGTY  (SEQ ID NO: 313)

Tyrosinase (192-200)
SEIWRDIDF  (SEQ ID NO: 314)

Tyrosinase (206-214), T9206
AFLPWHRLF  (SEQ ID NO: 315)

Tyrosinase (240-251)
DAEKCDICTDEY  (SEQ ID NO: 316)

Tyrosinase (450-462)
SYLQDSDPDSFQD  (SEQ ID NO: 317)

Tyrosinase (56-70)
QNILLSNAPLGPQFP  (SEQ ID NO: 318)

Tyrosinase(243-251), core nonamer sequence
KCDICTDEY  (SEQ ID NO: 319)

VEGFR-2/KDR I, murine
FSNSTNDILI  (SEQ ID NO: 320)

VEGFR-2/KDR II, murine
VILTNPISM  (SEQ ID NO: 321)

VEGFR2/KDR Antagonist
ATWLPPR  (SEQ ID NO: 322)

WP9QY, TNF-alpha Antagonist
YCWSQYLCY (Disulfide bridge: 2-8)  (SEQ ID NO: 323)

Human Cardiac Troponin I (hcTnI) (39-58)
SKISASRKLQLKTLLLQIAK  (SEQ ID NO: 324)

CART (55-102), human
VPIYEKKYGQVPMCDAGEQCAVRKGARIGKLCDCPRGTSCNSFLL
KCL (Disulfide bridge: 74-94, 68-86, and 88-101)  (SEQ ID NO: 325)

β-Casomorphin (1-7), human
YPFVEPI  (SEQ ID NO: 326)

TABLE 4-continued

Targets from which the Analogs are derived

Caspase Related Peptides
Ac-AEVD-pNA
Ac-AEVD-pNA

Biotin-Caspase 1 Inhibitor II
Biotin-YVAD-CMK
Biotin-Caspase 1 Substrate V

Caspase 1 (ICE) Inhibitor I
Ac-YVAD-CHO  (SEQ ID NO: 327)

Caspase 1 (ICE) Substrate 1, chromogenic
Ac-YEVD-pNA  (SEQ ID NO: 328)

Caspase 1 (ICE) Substrate 1m, fluorogenic
Ac-YEVD-AMC  (SEQ ID NO: 329)

Caspase 1 (ICE) Substrate 2, chromogenic
Ac-YVAD-pNA  (SEQ ID NO: 330)

Caspase 1 (ICE) Substrate 2f, fluorogenic
Ac-YVAD-AFC

Caspase 1 (ICE) Substrate 2f, fluorogenic
Ac-YVAD-AFC

Caspase 1 (ICE) Substrate 2m, fluorogenic
Ac-YVAD-AMC

Caspase 1 (ICE) Substrate 2r, fluorogenic
(Ac-YVAD)2-Rh110

Caspase 1 (ICE) Substrate 3f, fluorogenic
Ac-WEHD-AFC  (SEQ ID NO: 331)

Caspase 1 (ICE) Substrate 3f, fluorogenic
Ac-WEHD-AFC

Caspase I (ICE) Substrate 3m, fluorogenic
Ac-WEHD-AMC  (SEQ ID NO: 332)

Caspase 1 (ICE) Substrate 3r, fluorogenic
(Ac-WEHD)2-Rh110

Caspase 1 (ICE) substrate for FRET assays
DABCYL-YVADAPV-EDANS

Caspase 1 Inhibitor
Caspase 1 Inhibitor I

Caspase 1 Inhibitor II
Ac-YVAD-CMK

Caspase 1 Inhibitor IV, Boc-D-CMK
Boc-D(OBzl)-CMK

Caspase 1 Inhibitor VIII
Ac-WEHD-CHO

Caspase 1 Substrate III
Ac-WEHD-pNA  (SEQ ID NO: 334)

Caspase 2 (ICH-1) Substrate 1, chromogenic
Ac-VDVAD-pNA  (SEQ ID NO: 335)

Caspase 2 (ICH-1) Substrate 1, chromogenic
Ac-VDVAD-pNA

Caspase 2 (ICH-1) Substrate 1f, fluorogenic
Ac-VDVAD-AFC

Caspase 2 (ICH-1) Substrate 1m, fluorogenic
Ac-VDVAD-AMC

Caspase 2 (ICH-1) Substrate 2, fluorogenic
Mca-VDVADGWK(Dnp)-NH2  (SEQ ID NO: 336)

TABLE 4-continued

Targets from which the Analogs are derived

Caspase 2 Inhibitor
Ac-VDVAD-CHO  (SEQ ID NO: 337)

Caspase 2 Substrate 3r
(D)2-Rh110  (SEQ ID NO: 338)

Caspase 2 Substrate, chromogenic
Ac-VDQQD-pNA

Caspase 3 (163-175)
CRGTELDCGIETD  (SEQ ID NO: 339)

Caspase 3 (Apopain) Inhibitor 1
Ac-DEVD-CHO  (SEQ ID NO: 340)

Caspase 3 (Apopain) Inhibitor 1b
Biotin-DEVD-CHO  (SEQ ID NO: 341)

Caspase 3 (Apopain) Substrate 1, chromogenic
Ac-DEVD-pNA

Caspase 3 (Apopain) Substrate 1f, fluorogenic
Ac-DEVD-AFC

Caspase 3 (Apopain) Substrate 1m, fluorogenic
Ac-DEVD-AMC

Caspase 3 (Apopain) Substrate 1m, fluorogenic
Ac-DEVD-AMC

Caspase 3 (Apopain) Substrate 1r-z, fluorogenic
(Z-DEVD)2-Rh110

Caspase 3 (Apopain) Substrate 1z, chromogenic
Z-DEVD-pNA

Caspase 3 (Apopain) Substrate 2, chromogenic
Ac-DQMD-pNA  (SEQ ID NO: 342)

Caspase 3 Inhibitor 1
Ac-DMQD-CHO  (SEQ ID NO: 343)

Caspase 3 Substrate 1, chromogenic
Ac-DMQD-pNA  (SEQ ID NO: 344)

Caspase 3 Substrate 1f, fluorogenic
Ac-DMQD-AFC

Caspase 3 Substrate 1m, fluorogenic
Ac-DMQD-AMC

Caspase 3 Substrate 1r, fluorogenic
(Ac-DMQD)2-Rh110

Caspase 3 Substrate, chromogenic
Ac-VQVD-pNA  (SEQ ID NO: 345)

Caspase 4 (ICH-2) Substrate 1, chromogenic
Ac-LEVD-pNA  (SEQ ID NO: 346)

Caspase 4 (ICH-2) Substrate 1f, fluorogenic
Ac-LEVD-AFC

Caspase 4 (ICH-2) Substrate 1m, fluorogenic
Ac-LEVD-AMC

Caspase 4 (ICH-2) Substrate 1r, fluorogenic
(Ac-LEVD)2-Rh110

Caspase 6 (Mch 2) Inhibitor 1
Ac-VEID-CHO  (SEQ ID NO: 347)

Caspase 6 (Mch2) Substrate 1, chromogenic
Ac-VEID-pNA  (SEQ ID NO: 348)

Caspase 6 (Mch2) Substrate 1f, fluorogenic
Ac-VEID-AFC

TABLE 4-continued

Targets from which the Analogs are derived

Caspase 6 (Mch2) Substrate 1m, fluorogenic
Ac-VEID-AMC

Caspase 6 (Mch2) Substrate 1r, fluorogenic
(Ac-VEID)2-Rh110

Caspase 6 (Mch2) Substrate 2, fluorogenic
Mca-VQVDGW-K(Dnp)-NH2

Caspase 6 Substrate V, fluorogenic
Ac-VEHD-AFC

Caspase 8 Inhibitor 1
Ac-IETD-CHO

Caspase 8 Substrate 1, chromogenic
Ac-IETD-pNA

Caspase 8 Substrate 1f, fluorogenic
Ac-IETD-AFC

Caspase 8 Substrate 1f-z, fluorogenic
Z-IETD-AFC

Caspase 8 Substrate 1m, fluorogenic
Ac-IETD-AMC

Caspase 8 Substrate 1r-z, fluorogenic
(Z-IEHD)2-Rh110

Caspase 8 Substrate 1r-z, fluorogenic
(Z-IETD)2-Rh110

Caspase 9 Substrate 1, chromogenic
Ac-LEHD-pNA

Caspase 9 Substrate 1f, fluorogenic
Ac-LEHD-AFC

Caspase 9 Substrate 1r, fluorogenic
(Ac-LEHD)2-Rh110

Caspase 9 Substrate 2m, fluorogenic
Ac-LEHD-AMC

Caspase Inhibitor II CHO
Ac-VAD-CHO

Caspase Inhibitor II CMK
Ac-VAD-CMK

Caspase-1 Substrate V, Fluorogenic
Mca-YVADAP-K(Dnp)

Caspase-1/Caspase-4 Substrate II, Fluorogenic
Ac-WVAD-AMC

ICE Inhibitor I, cell permeable
Ac-AAVLPAVLLALLAPYVAD-CHO (SEQ ID NO: 349)

Smac N7 Protein
AVPIAQK
Z-DEVD-AFC
Z-DEVD-AMC (SEQ ID NO: 350)

37, 43Gap 27, Connexin Mimetic
SRPTEKTIFII (SEQ ID NO: 351)

37, 40 GAP26, Connexin Mimetic
VCYDQAFPISHIR (SEQ ID NO: 352)

40Gap 27, Connexin Mimetic
SRPTEKNVFIV (SEQ ID NO: 353)

43Gap 26, Connexin Mimetic
VCYDKSFPISHVR (SEQ ID NO: 354)

TABLE 4-continued

Targets from which the Analogs are derived

43Gap 36, Connexin Mimetic
KRDPCHQVDCFLSRPTEK  (SEQ ID NO: 355)

Alpha B-Crystallin (73-92)
DRFSVNLDVKHFSPEELKVK  (SEQ ID NO: 356)

Calreticulin (CRT) Binding Peptide 1
GQPMYGQPMY  (SEQ ID NO: 357)

Calreticulin (CRT) Binding Peptide 1, biotin-labeled
BIOTIN-GQPMYGQPMY

DAM1 (221-241)
SFVLNPTNIGMSKSSQGHVTK  (SEQ ID NO: 358)

Hyaluronan Inhibitor
GAHWQFNALTVR  (SEQ ID NO: 359)

L1CD cell adhesion molecule (1144-1163)
KRSKGGKYSVKDKEDTQVDS  (SEQ ID NO: 360)

L1FLCD (1173-1185)
FGEYRSLESDNEE  (SEQ ID NO: 361)

pALA, Polyalanine Peptide
AAADAAAAL  (SEQ ID NO: 362)

S1P1
VSTSIPEVKALRSSVSDYGNYDIIVRHYNYTGKLNIGAEKDHGIK  (SEQ ID NO: 363)

Pen2W2F, FAM Labeled
5-FAM-RQIKIFFQNRRMKFKK-NH2  (SEQ ID NO: 364)

Hel 11-7 NEW
KLLKLLLKLWLKLLKLLL  (SEQ ID NO: 365)

HIV-1 Rev (34-50)
TRQARRNRRRRWRERQR  (SEQ ID NO: 366)

HIV-1 Tat (48-60)
GRKKRRQRRRPPQ  (SEQ ID NO: 367)

Human T-cell Lymphotrophic Virus (HTLV)-II Rex, (4-16)
TRRQRTRRARRNR  (SEQ ID NO: 368)

Lipid Membrane Translocating Peptide
KKAAAVLLPVLLAAP  (SEQ ID NO: 369)

Lipid Membrane Translocating Peptide, D-isomer
kkaaavllpvllaap  (SEQ ID NO: 370)

Mastoparan
INLKALAALAKKIL-NH2  (SEQ ID NO: 371)

Mastoparan 7
INLKALAALAKALL-NH2  (SEQ ID NO: 372)

Mastoparan X
INWKGIAAMAKKLL-NH2  (SEQ ID NO: 373)

MEK1 Derived Peptide Inhibitor 1
MPKKKPTPIQLNP  (SEQ ID NO: 374)

Membrane-Permeable Sequence, MPS
AAVALLPAVLLALLAK  (SEQ ID NO: 375)

MPGΔNLS, HIV related;
GALFLGFLGAAGSTMGAWSQPKSKRKV  (SEQ ID NO: 376)

MPS-Gαi2
AAVALLPAVLLALLAKNNLKDCGLF  (SEQ ID NO: 377)

MPS-Gαi3
AAVALLPAVLLALLAKNNLKECGLY  (SEQ ID NO: 378)

Myristoyl-MEK1 Derived Peptide Inhibitor 1
Myr-MPKKKPTPIQLNP

TABLE 4-continued

Targets from which the Analogs are derived

NGR Peptide 1
CNGRCGGklaklakklaklaklak-NH2 (Disulfide bridge: 1-5)  (SEQ ID NO: 379)

NGR Peptide 2
CNGRCGGLVTT (Disulfide bridge: 1-5)  (SEQ ID NO: 380)

NGR Peptide 3
CNGRC-NH2 (Disulfide bridge: 1-5)  (SEQ ID NO: 381)

NGR Peptide 4
CNGRCGGkklklllkll (Disulfide bridge: 1-5)  (SEQ ID NO: 382)

Nuclear Localiation Signal Peptide
PKKKRKV  (SEQ ID NO: 383)

P22 N (14-30)
NAKTRRHERRRKLAIER  (SEQ ID NO: 384)

PenArg, FAM Labeled
5-FAM-RQIRIWFQNRRMRWRR-NH2  (SEQ ID NO: 385)

Pep-1-Cysteamine
Ac-KETWWETWWTEWSQPKKKRKV-cysteamine  (SEQ ID NO: 386)

Pep-1: Chariot (Non-Covalent Delivery of Peptides and Proteins)
KETWWETWWTEWSQPKKKRKV  (SEQ ID NO: 387)

phi 21 N Peptide (12-29)
TAKTRYKARRAELIAERR  (SEQ ID NO: 388)

Phospho-IkBa-derived peptide, FAM labeled
5-FAM-GRHDSGLD-pS-MK-NH2  (SEQ ID NO: 389)

Rabies Virus Glycoprotein (RVG)
YTIWMPENPRPGTPCDIFTNSRGKRASNG  (SEQ ID NO: 390)

Rabies Virus Matrix Protein Fragment (RV-MAT)
MNLLRKIVKNRRDEDTQKSSPASAPLDDG  (SEQ ID NO: 391)

Stearyl-MEK-1 Derived Peptide Inhibitor 1, amide
Ste-MPKKKPTPIQLNP-NH2  (SEQ ID NO: 392)

SV-40 Large T-antigen Nuclear Localization Signal (NLS)
CGGGPKKKRKVED  (SEQ ID NO: 393)

SV40 T-Ag-derived Nuclear Localization Signal (NLS) Peptide
PKKKRKVEDPYC  (SEQ ID NO: 394)

SynB1
RGGRLSYSRRRFSTSTGRA  (SEQ ID NO: 395)

TAT (47-57)
YGRKKRRQRRR  (SEQ ID NO: 396)

TAT (47-57)
YGRKKRRQRRR

TAT (47-57) GGG-Cys(Npys)
YGRKKRRQRRRGGG-C(Npys)-NH2

TAT (47-57), FAM-labeled
FAM-YGRKKRRQRRR

TAT (47-57), TAMRA-labeled
TAMRA-YGRKKRRQRRR

TAT (47-57)-Lys(TAMRA)
YGRKKRRQRRR-K(TAMRA)

Tat (48-57)
GRKKRRQRRR  (SEQ ID NO: 397)

Tat-C (48-57)
CGRKKRRQRRR  (SEQ ID NO: 398)

Tat-NR2Bct
YGRKKRRQRRRKLSSIESDV  (SEQ ID NO: 399)

TABLE 4-continued

Targets from which the Analogs are derived

TAT-NSF222 Fusion Peptide
YGRKKRRQRRR-GGG-LDKEFNSIFRRAFASRVFPPE  (SEQ ID NO: 400)

TAT-NSF700 Fusion Peptide
YGRKKRRQRRR-GGG-LLDYVPIGPRFSNLVLQALLVL  (SEQ ID NO: 401)

Transdermal Peptide
ACSSSPSKHCG  (SEQ ID NO: 402)

Transportan
GWTLNSAGYLLGKINLKALAALAKKIL  (SEQ ID NO: 403)

Yeast PRP6 (129-144)
TRRNKRNRIQEQLNRK  (SEQ ID NO: 404)

{Cys58}105Y, Cell Penetrating Peptide, α1-antitrypsin (358-374)
CSIPPEVKFNKPFVYLI  (SEQ ID NO: 405)

105Y, α1-antitrypsin (359-374)
SIPPEVKFNKPFVYLI  (SEQ ID NO: 406)

Aminopeptidase N Ligand (CD13), NGR peptide
CNGRCG (Disulfide bridge: 1-5)  (SEQ ID NO: 407)

Antennapedia Leader Peptide (CT)
KKWKMRRNQFWVKVQRG  (SEQ ID NO: 408)

Antennapedia Peptide, acid
RQIKIWFQNRRMKWKK  (SEQ ID NO: 409)

Antennapedia Peptide, amide
RQIKIWFQNRRMKWKK-NH2  (SEQ ID NO: 410)

Antennapedia Peptide, FAM-labeled
5-FAM-RQIKIWFQNRRMKWKK-NH2  (SEQ ID NO: 411)

Anti-BetaGamma (MPS-Phosducin-like protein C terminus)
AAVALLPAVLLALLAVTDQLGEDFFAVDLEAFLQEFGLLPEKE  (SEQ ID NO: 412)

Bcl-2 Binding Peptide, cell permeable
Decanoyl-KNLWAAQRYGRELRRMSDEFEGSFKGL  (SEQ ID NO: 413)

Alpha-A-Crystallin (70-88)
KFVIFLDVKHFSPEDLTVK  (SEQ ID NO: 414)

Hsc70-binding Peptide II
NIVRKKK  (SEQ ID NO: 415)

Cholecystokinin-Pancreozymin Peptides
{Thr28, Nle31}-Cholecystokinin (25-33), sulfated
RD-Y(SO3H)-TGW-Nle-DF-NH2  (SEQ ID NO: 416)

Caerulein
Pyr-QD-Y(SO3H)-TGWMDF-NH2  (SEQ ID NO: 417)

Cholecystokinin (1-21)
KAPSGRVSMIKNLQSLDPSHR  (SEQ ID NO: 418)

Cholecystokinin (10-20)
IKNLQSLDPSH  (SEQ ID NO: 419)

Cholecystokinin (26-33), CCK Octapeptide, sulfated
D-Y(SO3H)-MGWMDF-NH2  (SEQ ID NO: 420)

Cholecystokinin (26-33), CCK8
DYMGWMDF-NH2  (SEQ ID NO: 421)

Cholecystokinin (26-33), free acid
DYMGWMDF

Cholecystokinin Flanking Peptide, non-sulfated
SAEEYEYPS  (SEQ ID NO: 422)

Cholecystokinin, CCK (27-33), CCK7
YMGWMDF-NH2  (SEQ ID NO: 423)

TABLE 4-continued

Targets from which the Analogs are derived

Prepro CCK fragment, V-9-M
VPVEAVDPM (SEQ ID NO: 424)

CRF
{Tyr0}-Corticotropin Releasing Factor, {Tyr0}-CRF, human, rat
YSEEPPISLDLTFHLLREVLEEMARAEQLAQQAHSNRKLMEII-NH2 (SEQ ID NO: 425)

{Tyr0}-Corticotropin Releasing Factor, {Tyr0}-CRF, ovine
YSQEPPISLDLTFHLLREVLEMTKADQLAQQAHSNRKLLDIA-NH2 (SEQ ID NO: 426)

Biotin-Corticotropin Releasing Factor, Biotin-CRF, human, rat
Biotin-SEEPPISLDLTFHLLREVLEMARAEQLAQQAHSNRKLMEII-NH2

Corticotropin Releasing Factor, CRF, human, rat
SEEPPISLDLTFHLLREVLEMARAEQLAQQAHSNRKLMEII-NH2 (SEQ ID NO: 427)

Somatostatin
{Tyr0}-Somatostatin 28
YSANSNPAMAPRERKAGCKNFFWKTFTSC (Disulfide bridge: 18-29 (SEQ ID NO: 428)

{Tyr1}-Somatostatin 14
YGCKNFFWKTFTSC (Disulfide bridge: 3-14) (SEQ ID NO: 429)

Big Endothelin-1 (1-38), human
CSCSSLMDKECVYFCHLDIIWVNTPEHVVPYGLGSPRS(Disulfide bridge: 1-15 and 3-11) (SEQ ID NO: 430)

1: VIP vasoactive intestinal peptide isoform 1 preprotein
>gi|4507897|ref|NP_003372.1|VIP peptides isoform 1 preproprotein {Homo sapiens}
MDTRNKAQLLVLLTLLSVLFSQTSAWPLYRAPSALRLGDRIPFEGANEPDQVSLKEDIDMLQ
NALAENDTPYYDVSRNARHADGVFTSDFSKLLGQLSAKKYLESLMGKRVSSNISEDPVPVKR
HSDAVFTDNYTRLRKQMAVKKYLNSILNGKRSSEGESPDFPEELEK
(SEQ ID NO: 431)

Residues 125-152 constitute the active form:
HSDAVFTDNYTRLRKQMAVKKYLNSILN
VPAC$_1$ Interacting residues are likely (numbered from 1 using the active sequence):
H1, V5, F6, R14, K15, K21, Y22, L23, N24, and I26
VPAC$_2$ Interacting residues are likely (numbered from 1 using the active sequence):
H1, V5, T11, R14, K15, K21, Y22, L23, I26 and N28

2: VIP vasoactive intestinal peptide isoform 2 preprotein
>gi|37588853|ref|NP_919416.1|VIP peptides isoform 2 preproprotein {Homo sapiens}
MDTRNKAQLLVLLTLLSVLFSQTSAWPLYRAPSALRLGDRIPFEGANEPDQVSLKEDIDMLQ
NALAENDTPYYDVSRNARHADGVFTSDFSKLLGQLSAKKYLESLMGKRVSNISEDPVPVKR
HSDAVFTDNYTRLRKQMAVKKYLNSILNGKRSSEGESPDFPEELEK
(SEQ ID NO: 432)

Residues 124-151 constitute the active form:
HSDAVFTDNYTRLRKQMAVKKYLNSILN

VPAC$_1$ Interacting residues are likely (numbered from 1 using the active sequence):
H1, V5, F6, R14, K15, K21, Y22, L23, N24, and I26
VPAC$_2$ Interacting residues are likely (numbered from 1 using the active sequence):
H1, V5, T11, R14, K15, K21, Y22, L23, I26 and N28

3. VIP Synthetic sequence 1 HSDAVFTDNYTRLRKQVAAKKYLQSIKNKRY (Bay55-9837) (SEQ ID NO: 433)

4. VIP Synthetic sequence 2 HADAVFTAAYARLRKQMAAKKALAAIAA (10Ala) (SEQ ID NO: 434)

5. VIP Synthetic sequence 3 HSDAVFTDNYARLRKQMAVKKALNSILA (3Ala) (SEQ ID NO: 435)

6. VIP Synthetic sequence 1 YFDAIFTNSYRKVLGQLSARKLLQDIMSR AcYF-GRF1-29 (SEQ ID NO: 436)

7. VIP Synthetic sequence 2 FTDNYTRLRKQMAVKKYLNSILN VIP 6-28 (SEQ ID NO: 437)

8. VIP Synthetic sequence 3 HSDAVFTDNYTRLRKQLAVKKYLNSILN (F-6 = p-Cl-dF) (SEQ ID NO: 438)

9. VIP Synthetic sequence Ac-HSDAVFTDNYTRLRKQVAAKKYLQSIKNKRY (SEQ ID NO: 439)

10. VIP Synthetic sequence HTDAVFTDNYTRLRKQVAAKKYLQSIKNKRY (SEQ ID NO: 440)

11. VIP Synthetic sequence HSEAVFTDNYTRLRKQVAAKKYLQSIKNKRY (SEQ ID NO: 441)

12. VIP Synthetic sequence HSDAVFTDQYTRLRKQVAAKKYLQSIKQRY (SEQ ID NO: 442)

13. VIP Synthetic sequence HTEAVFTDNYTRLRKQVAAKKYLQSIKNKRY (SEQ ID NO: 443)

TABLE 4-continued

Targets from which the Analogs are derived

14. VIP Synthetic sequence HTEAVFTDQYTRLRKQVAAKKYLQSIKQKRY (SEQ ID NO: 444)

15. VIP Synthetic sequence Ac-HTDAVFTDQYTRLRKQVAAKKYLQSIKQKRY (SEQ ID NO: 445)

16. VIP Synthetic sequence HSDAVFTDNYTRLRKQVAAKKYLQSIKNKRYC (SEQ ID NO: 446)

17. VIP Synthetic sequence HSDAVFTDNYTRLRKQVAAKKYLQSIKNKRYC-PEG22kD (SEQ ID NO: 447)

18. VIP Synthetic sequence HSDAVFTDNYTRLRKQVAAKKYLQSIKNKRYC-PEG43kD (SEQ ID NO: 448)

19. VIP Synthetic sequence HSDAVFTDNYTRLRKQVAAKKYLQSIKNKRYSWC (SEQ ID NO: 449)

20. VIP Synthetic sequence HSDAVFTDNYTRLRKQVAAKKYLQSIKNKRYSWC-PEG22kD (SEQ ID NO: 450)

21. VIP Synthetic sequence HSDAVFTDNYTRLRKQVAAKKYLQSIKNKRYSWC-PEG43kD (SEQ ID NO: 451)

22. VIP Synthetic sequence HSDAVFTDQYTRLRKQVAAKKYLQSIKQKRYC (SEQ ID NO: 452)

23. VIP Synthetic sequence HSDAVFTDQYTRLRKQVAAKKYLQSIKQKRYC-PEG22kD (SEQ ID NO: 453)

24. VIP Synthetic sequence HSDAVFTDQYTRLRKQVAAKKYLQSIKQKRYC-PEG43kD (SEQ ID NO: 454)

25. VIP Synthetic sequence Ac-HSDAVFTENYTKLRKQN$_{le}$AAKK*YLND*LKKGGT(Ro25-1553) (SEQ ID NO: 455)

26. VIP Synthetic sequence Ac-HSDAVFTENY$_M$TKLRKQN$_{le}$AAKK*YLND*LKK (Ro 25-1392) (SEQ ID NO: 456)

27. VIP Synthetic sequence HSDAVFTDNYTRLRRQLAVRRYLNSILNGRR (LK312532) (SEQ ID NO: 457)

28. VIP Synthetic sequence Ac-H$_d$FDAVFTNSYRKVLKRLSARKLLQDIL (PG 97-269) (SEQ ID NO: 458)

29. VIP Synthetic sequence HSDAVFTNSYRKVLKRLSARKLLQDIL(k15r16127VIP GFR) (SEQ ID NO: 459)

30. VIP Synthetic sequence H$_d$ADAIFTA$_{ib}$AYRKVLAALA$_{ib}$ARKALAAAG$_{ab}$(GFR-6) (SEQ ID NO: 460)

31. VIP Synthetic sequence HSDGLFTSEYSKMRGRAQVQKFIQNLM (R16-chicken) (SEQ ID NO: 461)

32. VIP Synthetic sequence HSDAVFTDYYTRLRKQMD$_{ip}$VKKYLNSILN (y9Dip18-VIP) (SEQ ID NO: 462)

33. VIP Synthetic sequence FTDYYTRLRKQMD$_{ip}$VKKYLNSILN (y9Dip18-VIP) (SEQ ID NO: 463)

34. VIP Synthetic sequence HSDAVFTDNYTK$_m$LRKQMAVKKYLNSIKKGGT (SEQ ID NO: 464)

35. VIP Synthetic sequence Ac-HSDAVFTNSYRKVLKRLSARKLLQDIL (PG 97-268) (SEQ ID NO: 465)

36. VIP Synthetic sequence Ac-HDAI$_d$RTNSYRKVLKRLSAKKYLQDIN$_{leD}$R$_h$R (JV-1-53?) (SEQ ID NO: 466)

37. VIP Synthetic sequence Ac-H$_d$FDAIF$_{4cl}$TNRYRKVLA$_{bu}$QLSARKLLQDIN$_{leD}$R$_h$R(JV-1-51) (SEQ ID NO: 467)

38. VIP synthetic sequence HSDAVFTDQYTRLRKQLAAKKYLQSLKKKRY (RBAYL) (SEQ ID NO: 468)

39. VIP synthetic sequence HSDAVFTDNYTRLRKQVAAKKYLQSLKNKRY (rBAY) (SEQ ID NO: 469)

40. VIP synthetic sequence Hexanoyl-HSDAVFTDNYTRLRKQMAVKKYLNSILN (c6VIP) (SEQ ID NO: 470)

41. VIP synthetic sequence Hexanoyl-HSDAVFTDNYTRLRKQMAAKKYLNSIKK (c6a19k27k28-VIP) (SEQ ID NO: 471)

HSDAVFTEQY(OMe)TRAibRAibQLAAAibOrnY(OMe)LQSIK AibOrn (SEQ ID NO: 472)
HSDAVFTEK(CO(CH$_2$)$_2$SH)Y(OMe)TOrnLRAibQVAAAibOrn YLQSIOrnOrn (SEQ ID NO: 473)
HSDAVFTEQY(OMe)TOrnLRAibQVAAAibOrnYLQSIOrnK(W) Orn (SEQ ID NO: 474)
HSDAVFTEQY(OMe)TOrnLRAibQVAAibK(CO(CH$_2$)$_2$SH)YLQ SIOrnOrn (SEQ ID NO: 475)
HSDAVFTEQY(OMe)TOrnLRAibQVAAK CO(CH$_2$)$_2$SH)OrnYLQ SIOrnOrn (SEQ ID NO: 476)
HSDAVFTEQY(OMe)TOrnLRAibQVCAAibOrnYLQSIOrnOrn (SEQ ID NO: 477)
HSDAVFTEQY(OMe)TOrnLRCQVAAAibOrnYLQSIOrnOrn (SEQ ID NO: 478)
HSDAVFTEQY(OMe)TOrnLRAibQLAAAibOrnYLQSIOrnOrn (SEQ ID NO: 479)
HSDAVFTEQY(OMe)TOrnLRAibQVAAAibOrnYAibQSIOrnOrn (SEQ ID NO: 480)
HSDAVFTEQY(OMe)TOrnLRAibQVAAAibOrnYLQAibIOrnOrn (SEQ ID NO: 481)
HSDAVFTEQY(OMe)TOrnLRAibQVAAbuAibOrnYLQAibIOrnOrn (SEQ ID NO: 482)
HSDAVFTEQY(OMe)TOrnLRAibQLAAAibOrnYLQAibIOrnOrn (SEQ ID NO: 483)
HSDAVFTEQY(OMe)TOrnLRAibQLAAAibOrnYAibQAibIOrnOrn (SEQ ID NO: 484)
HSDAVFTEQY(OMe)TOrnLRAibQLAAbuAibOrnYAibQSIOrnOrn (SEQ ID NO: 485)
HSDAVFTEQY(OMe)TOrnLRAibQLAAbuAibOrnYLQSIOrnOrn (SEQ ID NO: 486)
HSDAVFTEQY(OMe)TOrnLRAibQLAAbuAibOrnYAibQAibIOrn Orn (SEQ ID NO: 487)
HSDAVFTEQY(OMe)TOrnLRAibQLAAAibOrnYAibQSIOrnOrn (SEQ ID NO: 488)
HSDAVFTEQY(OMe)TOrnLRK(W)QVAAAibOrnYLQSIOrnOrn (SEQ ID NO: 489)
HSDAVFTEQY(OMe)TOrnLRAibQVAAAibOrnYLK(W)SIOrnOrn (SEQ ID NO: 490)
HSDAVFTEQY(OMe)TOrnLRAibQK(W)AAAibOrnYLQSIOrnOrn (SEQ ID NO: 491)
HSDAVFTEQY(OMe)TOrnLRK CO(CH$_2$)$_2$SH)QVAAAibOrnYLQ SIOrnOrn (SEQ ID NO: 492)

TABLE 4-continued

Targets from which the Analogs are derived

HSDAVFTEQY(OMe)TOrnLRAibQVAAAibK(W)YLQSIOrnOrn  (SEQ ID NO: 493)
HSDAVFTEQY(OMe)TOrnLRAibQVAAAibCYLQSIOrnOrn  (SEQ ID NO: 494)
HSDAVFTEQY(OMe)TOrnLRAibQLAAbuAibOrnYLQAibIOrnOrn  (SEQ ID NO: 495)
HSDAVFTEQY(OMe)TOrnLRAibQVAAAibOrnYLQSK(W)OrnOrn  (SEQ ID NO: 496)
HSDAVFTEQY(OMe)TOrnLRAibQLAAbuAibOrnYLQAibIOrnC Orn  (SEQ ID NO: 497)
HSDAVFTEQY(OMe)TOrnLRAibQLAAbuAibOrnYLQAibCOrn Orn  (SEQ ID NO: 498)
HSDAVFTEQY(OMe)TOrnLRAibQCAAbuAibOrnYLQAibIOrnOrn  (SEQ ID NO: 499)
HSDAVFTEQY(OMe)TOrnLRCQLAAbuAibOrnYLQAibIOrnOrn  (SEQ ID NO: 500)
HSDAVFTEQY(OMe)TOrnLRAibQVK CO(CH$_2$)$_2$SH)AAibOrn YLQSIOrnOrn  (SEQ ID NO: 501)
HSDAVFTEQY(OMe)TOrnLRAibQLAAbuAibOrnYLQSIOrnCOrn  (SEQ ID NO: 502)
HSDAVFTEQY(OMe)TOrnLRAibQLAAbuAibOrnYLQSCOrnOrn  (SEQ ID NO: 503)
HSDAVFTEQY(OMe)TOrnLRAibQLAAbuAibOrnYLQAibIOrn K CO(CH$_2$)$_2$SH)Orn  (SEQ ID NO: 504)
HSDAVFTEQY(OMe)TOrnLRAibQLAAbuAibOrnYLQSIOrn K CO(CH$_2$)$_2$SH)Orn  (SEQ ID NO: 505)
HSDAVFTEQY(OMe)TOrnLRK(W)QLAAbuAibOrnYLQAibIOrn Orn  (SEQ ID NO: 506)
HSDAVFTEQY(OMe)TOrnLRAibQLAAAibOrnYLQSIOrnOrnC  (SEQ ID NO: 507)
HSDAVFTEQY(OMe)TOrnLRAibQVAAAibOrnYLQSIOrnOrnC  (SEQ ID NO: 508)
HSDAVFTEQY(OMe)TOrnLRAibQLAAbuAibOrnYLQSIOrnOrnC  (SEQ ID NO: 509)
HSDAVFTEQY(OMe)TOrnLRAibQLAAbuAibOrnY(OMe)LQAibI OrnOrn  (SEQ ID NO: 510)
HSDAVFTEQY(OMe)TOrnLRAibQLAAbuAibOrnY(OMe)LQAibI OrnCOrn  (SEQ ID NO: 511)
HSDAVFTEQY(OMe)TOrnLRAibQCAAbuAibOrnY(OMe)LQAibI OrnOrn  (SEQ ID NO: 512)
HSDAVFTEQY(OMe)TOrnLRAibQLAAbuAibOrnYLQAibIOrn OrnC  (SEQ ID NO: 513)
HSDAVFTEQY(OMe)TOrnLRAibQLAAbuAibOrnY(OMe)LQSI OrnOrn  (SEQ ID NO: 514)
HSDAVFTEQY(OMe)TOrnLRAibQCAAbuAibOrnY(OMe)LQSI OrnOrn  (SEQ ID NO: 515)
HSDAVFTEQY(OMe)TOrnLRAibQCAAbuAibOrnY(OMe)LQSI OrnOrn  (SEQ ID NO: 516)
HSDAVFTEQY(OMe)TOrnLRAibQLAbuAAibOrnYLQSIOrnOrn  (SEQ ID NO: 517)
HSDAVFTEQY(OMe)TOrnLRAibQK CO(CH$_2$)$_2$SH)AAbu AibOrnYLQAibIOrnOrn  (SEQ ID NO: 518)
HSDAVFTEQY(OMe)TOrnLRAibQK(W)AAbuAibOrnYLQ AibIOrnOrn  (SEQ ID NO: 519)

3. pituitary adenylate cyclase-activating polypeptide precursor {Homo sapiens}
>gi|153266792|ref|NP_001093203.1|pituitary adenylate cyclase-activating polypeptide precursor
{Homo sapiens}

MTMCSGARLALLVYGIIMHSSVYSSPAAAGLRFPGIRPEEEAYGEDGNPLPDFDGSEPPGAGS
PASAPRAAAAWYRPAGRRDVAHGILNEAYRKVLDQLSAGKHLQSLVARGVGGSLGGGAGD
DAEPLSKRHSDGIFTDSYSRYRKQMAVKKYLAAVLGKRYKQRVKNKGRRIAYL
(SEQ ID NO: 520)

Residues 132-158 constitute the active form PACAP-27:
HSDGIFTDSYSRYRKQMAVKKYLAAVL
Residues 132-158 constitute the active form PACAP-38:
HSDGIFTDSYSRYRKQMAVKKYLAAVLGKRYKQRVKNK 4. pituitary adenylate cyclase-activating polypeptide precursor {Homo sapiens}
>gi|153266795|ref|NP_001108.2|pituitary adenylate cyclase-activating polypeptide precursor {Homo
sapiens}
MTMCSGARLALLVYGIIMHSSVYSSPAAAGLRFPGIRPEEEAYGEDGNPLPDFDGSEPPGAGS
PASAPRAAAAWYRPAGRRDVAHGILNEAYRKVLDQLSAGKHLQSLVARGVGGSLGGGAGD
DAEPLSKRHSDGIFTDSYSRYRKQMAVKKYLAAVLGKRYKQRVKNKGRRIAYL
(SEQ ID NO: 521)

Residues 132-158 constitute the active form PACAP-27:
HSDGIFTDSYSRYRKQMAVKKYLAAVL
Residues 132-158 constitute the active form PACAP-38:
HSDGIFTDSYSRYRKQMAVKKYLAAVLGKRYKQRVKNK 39. PACAP-Antagonist
FTDSYSRYRKQMAVKKYLAAVLGKRYKQRVKNK  (SEQ ID NO: 522)

40. Maxadilan peptide
>US6462016_1 Sequence 1 from Patent U.S. Pat. No. 6,462,016 inClaims gi: 27279414
CDATCQFRKAIDDCQKQAHHSNVLQTSVQTTATFTSMDTSQLPGNSVFKECMKQKKKEFKA  (SEQ ID NO: 523)

40. Maxadilan peptide 2
CDATCQFRKAIDDCQKQAHHSNVLQTSVQTTATFTSMDTSQLPGNSVFKECMKQKKKEFSS
GK  (SEQ ID NO: 524)

40. M65 peptide
CDATCQFRKAIDDCQKQAHHSNVLPGNSVFKECMKQKKKEFKA  (SEQ ID NO: 525)

40. M65 peptide v2.
CDATCQFRKAIDDCQKQAHHSNVLGNSVFKECMKQKKKEFKA  (SEQ ID NO: 526)

41. M65 peptide
>US6462016_10 Sequence 10 from Patent U.S. Pat. No. 6,462,016 inClaims gi: 27279423
GSCDATCQFRKAIDDCQKQAHHSNVPGNSVFKECMKQKKKEFKAGK  (SEQ ID NO: 527)

The contents of this Table 4 also include relate to analogs comprising any agonist listed in US2009-
U.S. application Ser.\10/586,124, filed on Jun. 24, 2008

TABLE 4-continued

Targets from which the Analogs are derived 5. glucagon preproprotein
gi|4503945|ref|NP_002045.1|glucagon preproprotein {Homo sapiens}

MKSIYFVAGLFVMLVQGSWQRSLQDTEEKSRSFSASQADPLSDPDQMNEDKRHSQGTFTSD
YSKYLDSRRAQDFVQWLMNTKRNRNNIAKRHDEFERHAEGTFTSDVSSYLEGQAAKEFIAW
LVKGRGRRDFPEEVAIVEELGRRHADGSFSDEMNTILDNLAARDFINWLIQTKITDRK
(SEQ ID NO: 528)

Residues 21-50 constitute an active form Glicentin-related polypeptide (GRPP):
RSLQDTEEKSRSFSASQADPLSDPDQMNED   (SEQ ID NO: 529)

Residues 53-81 constitute an active form Glucagon:
HSQGTFTSDYSKYLDSRRAQDFVQWLMNT   (SEQ ID NO: 530)

Residues 92-128 constitute the pro-form of GLP-1
HDEFERHAEGTFTSDVSSYLEGQAAKEFIAWLVKGRG   (SEQ ID NO: 531)
Residues 98-128 constitute an active form of GLP-1
HAEGTFTSDVSSYLEGQAAKEFIAWLVKGRG
Residues 98-125 constitute an active form of GLP-1
HAEGTFTSDVSSYLEGQAAKEFIAWLVK Residues 146-178 constitute an active form GLP-2:
HADGSFSDEMNTILDNLAARDFINWLIQTKITD   (SEQ ID NO: 532)

6. Apolipoprotein-mimetic peptide (D4F, DWFKAFYDKVAEKFKEAF)  (SEQ ID NO: 533) and other family
members:
3F-2 (Ac-DKWKAVYDKFAEAFKEFL-NH2)   (SEQ ID NO: 534)
3F14 (Ac-DWLKAFYDKVAEKFKEAF-NH2   (SEQ ID NO: 535)

The baseline sequence of 18A is DWLKAFYDKVAEKLKEAF.
Ac-18A-NH2
Ac-{F318A}NH2
Ac-{F1418A}NH2
Ac-{F3,1418A}NH2
Ac-{F11,14,1718A}NH2
Ac-{F10,11,14,1718A}NH2
Ac-{F3,10,11,14,1718A}NH2

4F = Ac-DWFKAFYDKVAEKFKEAF-NH2 (18 mer)
4F-KVEPLRA-4F (43 mer)
4F-P-4F (37 mer)
4F-A-4F (37 mer)

apoA-IMilano (R173C) and apoA-IParis (R151C)

apolipoprotein A-I {Homo sapiens
gi|4557321|ref|NP_000030.1|apolipoprotein A-I preproprotein {Homo sapiens}
MKAAVLTLAVLFLTGSQARHFWQQDEPPQSPWDRVKDLATVYVDVLKDSGRDYVSQFEGS
ALGKQLNLKLLDNWDSVTSTFSKLREQLGPVTQEFWDNLEKETEGLRQEMSKDLEEVKAKV
QPYLDDFQKKWQEEMELYRQKVEPLRAELQEGARQKLHELQEKLSPLGEEMRDRARAHVD
ALRTHLAPYSDELRQRLAARLEALKENGGARLAEYHAKATEHLSTLSEKAKPALEDLRQGL
LPVLESFKVSFLSALEEYTKKLNTQ
(SEQ ID NO: 536)

I. apolipoprotein E {Homo sapiens}
>gi|178853|gb|AAB59397.1|apolipoprotein E {Homo sapiens}
MKVLWAALLVTFLAGCQAKVEQAVETEPEPELRQQTEWQSGQRWELALGRFWDYLRWVQ
TLSEQVQEELLSSQVTQELRALMDETMKELKAYKSELEEQLTPVAEETRARLSKELQAAQAR
LGADMEDVRGRLVQYRGEVQAMLGQSTEELRVRLASHLRKLRKRLLRDADDLQKRLAVY
QAGAREGAERGLSAIRERLGPLVEQGRVRAATVGSLAGQPLQERAQAWGERLRARMEEMG
SRTRDRLDEVKEQVAEVRAKLEEQAQQIRLQAEAFQARLKSWFEPLVEDMQRQWAGLVEK
VQAAVGTSAAPVPSDNH
(SEQ ID NO: 537)

II. Ac-L V GRQLEEFL-NH
III. Ac-LLEQLNEQFNWVSRLANLTQGE-NH2
Ac--PSGVTEVVVKLFDS-NH.sub.2
IV. Ac-Q QTHMLDVMQD-NH.sub.2.

V. Apolipoprotein C-I {Homo sapiens}
>gi|32822890|gb|AAH55093.1|Apolipoprotein C-I {Homo sapiens}
MRLFLSLPVLVVVLSIVLEGPAPAQGTPDVSSALDKLKEFGNTLEDKARELISRIKQSELSAK
MREWFSETFQKVKEKLKIDS
(SEQ ID NO: 538)

TABLE 4-continued

Targets from which the Analogs are derived

VI. apolipoprotein J {Homo sapiens}
>gi|27373753|gb|AAN87347.1|apolipoprotein J {Homo sapiens}
CSTNNPSQAKLRRELDESLQVAERLTRKYNELLKSYQWKMLNTSSLLEQLNEQFNWVSRLA
NLTQGEDQYYLRVTT
(SEQ ID NO: 539)

apoJ peptide 336--D-J336 = Ac-LLEQLNEQFNWVSRLANTQGE-NH$_2$

ANP
>gi|23510319|ref|NP_006163.1|atrial natriuretic factor preproprotein {Homo sapiens}
MSSFSTTTVSFLLLLAPQLLGQTRANPMYNAVSNADLMDFKNLLDHLEEKMPLEDEVVPPQ
VLSEPNEEAGAALSPLPEVPPWTGEVSPAQRDGGALGRGPWDSSDRSALLKSKLRALLTAPR
SLRRSSCFGGRMDRIGAQSGLGCNSFRY
(SEQ ID NO: 540)

Active form: RSLRRSSCFGGRMDRIGAQSGLGC (SEQ ID NO: 541)
Active form: RSLRRSSCFGGRMDRIGAQSGLGCNSFRY (SEQ ID NO: 542)
Active form: SLRRSSCFGGRMDRIGAQSGLGCNSFRY (SEQ ID NO: 543)

cardiodilatin
>gi|23510319: 26-92 atrial natriuretic factor preproprotein {Homo sapiens}
NPMYNAVSNADLMDFKNLLDHLEEKMPLEDEVVPPQVLSEPNEEAGAALSPLPEVPPWTGE
VSPAQR
(SEQ ID NO: 544)

BNP
natriuretic peptides B preproprotein {Homo sapiens}
>gi|4505433|ref|NP_002512.1|natriuretic peptides B preproprotein {Homo sapiens}
MDPQTAPSRALLLLLFLHLAFLGGRSHPLGSPGSASDLETSGLQEQRNHLQGKLSELQVEQTS
LEPLQESPRPTGVWKSREVATEGIRGHRKMVLYTLRAPRSPKMVQGSGCFGRKMDRISSSSG
LGCKVLRRH
(SEQ ID NO: 545)

Active form: SPKMVQGSGCFGRKMDRISSSSGLGCKVLRRH (SEQ ID NO: 546)

CNP
natriuretic peptide precursor C precursor {Homo sapiens}
>gi|13249346|ref|NP_077720.1|natriuretic peptide precursor C precursor {Homo sapiens}
MHLSQLLACALLLTLLSLRPSEAKPGAPPKVPRTPPAEELAEPQAAGGGQKKGDKAPGGGG
ANLKGDRSRLLRDLRVDTKSRAAWARLLQEHPNARKYKGANKKGLSKGCFGLKLDRIGSM
SGLGC
(SEQ ID NO: 547)

Active form: GLSKGCFGLKLDRIGSMSGLGC (SEQ ID NO: 548)

urodilatin
>gi|226320|prf||1506430A urodilatin
TAPRSLRRSSCFGGRMDRIGAQSGLGCNSFRY (SEQ ID NO: 549)

Urodilatin
RPATSLRRSSCFGGRMDRIGAQSGLGCNSFRY (SEQ ID NO: 550)

neuropeptide Y preproprotein {Homo sapiens}
>gi|4505449|ref|NP_000896.1|neuropeptide Y preproprotein {Homo sapiens}
MLGNKRLGLSGLTLALSLLVCLGALAEAYPSKPDNPGEDAPAEDMARYYSALRHYINLITRQ (SEQ ID NO: 551)
RYGKRSSP (SEQ ID NO: 552)
ETLISDLLMRESTENVPRTRLEDPAMW (SEQ ID NO: 553)

Active form:
>gi|4505449: 29-64 neuropeptide Y preproprotein {Homo sapiens}
YPSKPDNPGEDAPAEDMARYYSALRHYINLITRQRY (SEQ ID NO: 554)

PYY
peptide YY precursor {Homo sapiens}

>gi|71361686|ref|NP_004151.2|Human peptide YY precursor
MVFVRRPWPALTTVLLALLVCLGALVDAYPIKPEAPREDASPEELNRYYASLRHYLNLVTRQ (SEQ ID NO: 555)
RYGKRDGP (SEQ ID NO: 556)
DTLLSKTFFPDGEDRPVRSRSEGPDLW (SEQ ID NO: 557)

Active form: IKPEAPREDASPEELNRYYASLRHYLNLVTRQRY (SEQ ID NO: 558)
Active form: IKPEAFGEDASPEELNRYYASLRHYLNLVTRQRY (SEQ ID NO: 559)
Active form: YPIKPEAPREDASPEELNRYYASLRHYLNLVTRQRY (SEQ ID NO: 560)
Active form: YPIKPEAPGEDASPEELNRYYASLRHYLNLVTRQRY (SEQ ID NO: 561)

TABLE 4-continued

Targets from which the Analogs are derived adrenomedullin {Homo sapiens}
Active form: YRQSMNNFQGLRSFGCRFGTCTVQKLAHQIYQFTDKDNVAPRSKISPQGY  (SEQ ID NO: 562)
Pro-Adrenomedullin (N-20): ARLDVAAEFRKKWNKWALSR  (SEQ ID NO: 563)

PrePro-Adrenomedullin:
ELRMSSYPTGLADVKAGPAQTLIRPQDMKGASRSPEDSSPDAARIRV  (SEQ ID NO: 564)

Ghrelin analog sequences
{Ala1, D-Trp2,4, Leu6}-Ghrelin Receptor Agonist
AwFwLL  (SEQ ID NO: 565)

{D-Trp1,3, Leu5}-Ghrelin Core-Ligand
wFwLL  (SEQ ID NO: 566)

{Des-octanoyl}-Ghrelin, human
GSSFLSPEHQRVQQRKESKKPPAKLQPR  (SEQ ID NO: 567)

Biotin-GS-S(n-octanoyl)-FLSPEHQRVQQRKESKKPPAKLQPR  (SEQ ID NO: 568)

FAM-GS-S(n-octanoyl)-FLSPEHQRVQQRKESKKPPAKLQPR

TAMRA-GS-S(n-octanoyl)-FLSPEHQRVQQRKESKKPPAKLQPR human Obestatin analog sequences
FNAPFDVGIKLSGVQYQQHSQAL-NH2  (SEQ ID NO: 569)

PTH analog sequences
Parathyroid Hormone (1-34), human
SVSEIQLMHNLGKHLNSMERVEWLRKKLQDVHNF  (SEQ ID NO: 570)

Parathyroid Hormone (1-34), human, biotinylated
Biotin-SVSEIQLMHNLGKHLNSMERVEWLRKKLQDVHNF  (SEQ ID NO: 571)

Parathyroid Hormone (1-34), human, C-Terminal FAM-labeled
SVSEIQLMHNLGKHLNSMERVEWLRKKLQDVHNFK(FAM)

Parathyroid Hormone (1-34)-Lys(Biotin), human
SVSEIQLMHNLGKHLNSMERVEWLRKKLQDVHNFK(Biotin)

Parathyroid Hormone (1-34)-Lys(Biotin), human, FAM-labeled
FAM-SVSEIQLMHNLGKHLNSMERVEWLRKKLQDVHNFK(Biotin)

Parathyroid Hormone-Related Protein, PTHrP (107-111)
TRSAW  (SEQ ID NO: 572)

TIP 39, Tuberoinfundibular Neuropeptide
SLALADDAAFRERARLLAALERRHWLNSYMHKLLVLDAP  (SEQ ID NO: 573)

Hypercalcemia Malignancy Factor (1-40)
AVSEHQLLHDKGKSIQDLRRRFFLHHLIAEIHTAEIRATS  (SEQ ID NO: 574)

Acetalin analog sequences
Acetalin 1, Opioid Receptor Antagonist 1
Ac-RFMWMR-NH2  (SEQ ID NO: 575)

Acetalin 2, Opioid Receptor Antagonist 2
Ac-RFMWMK-NH2  (SEQ ID NO: 576)

Acetalin 3, Opioid Receptor Antagonist 3
Ac-RFMWMT-NH2  (SEQ ID NO: 577)

ACTH analog sequences
{Glu10}-ACTH (1-17)
SYSMEHFRWEKPVGKKR  (SEQ ID NO: 578)

{Phe2, Nle4}-ACTH (1-24)
SFS-Nle-EHFRWGKPVGKKRRPVKVYP  (SEQ ID NO: 579)

ACTH (1-10)
SYSMEHFRWG  (SEQ ID NO: 580)

ACTH (1-13), human
SYSMEHFRWGKPV  (SEQ ID NO: 581)

ACTH (1-24), human
SYSMEHFRWGKPVGKKRRPVKVYP  (SEQ ID NO: 582)

TABLE 4-continued

Targets from which the Analogs are derived

ACTH (1-39), human
SYSMEHFRWGKPVGKKRRPVKVYPNGAEDESAEAFPLEF  (SEQ ID NO: 583)

ACTH (18-39), human (CLIP)
RPVKVYPNGAEDESAEAFPLEF  (SEQ ID NO: 584)

ACTH (22-39)
VYPNGAEDESAEAFPLEF  (SEQ ID NO: 585)

ACTH (7-38), human
FRWGKPVGKKRRPVKVYPNGAEDESAEAFPLE  (SEQ ID NO: 586)
Biotin-ACTH (1-39), human
Biotin-SYSMEHFRWGKPVGKKRRPVKVYPNGAEDESAEAFPLEF Sauvagine
Pyr-GPPISIDLSLELLRKMIEIEKQEKEKQQAANNRLLLDTI-NH2  (SEQ ID NO: 587)

AGRP (25-51)
LAPMEGIRRPDQALLPELPGLGLRAPL  (SEQ ID NO: 588)

AGRP (54-82)
TTAEQAEEDLLQEAQALAEVLDLQDREPR  (SEQ ID NO: 589)

AGRP (87-132), human
Ac-CVRLHESCLGQQVPCCDPCATCYCRFFNAFCYCRKLGTAMNPCSRT  (SEQ ID NO: 590)

AGRP fragment (83-132), amide
SSRRCVRLHESCLGQQVPCCDPCATCYCRFFNAFCYCRKLGTAMNPCSRT-NH2 (5 disulfide
bridges)  (SEQ ID NO: 591)

Allatostatin I (free acid)
APSGAQRLYGFGL  (SEQ ID NO: 592)

Allatostatin I, Dip-AST7, cockroach
APSGAQRLYGFGL-NH2  (SEQ ID NO: 593)

Allatostatin II
GDGRLYAFGL-NH2  (SEQ ID NO: 594)

Allatostatin III
GGSLYSFGL-NH2  (SEQ ID NO: 595)

Allatostatin IV
DRLYSFGL-NH2  (SEQ ID NO: 596)

Allatostatin VI
YPQEHRFSFGL-NH2  (SEQ ID NO: 597)

Allatostatin VII
DGRMYSFGL-NH2  (SEQ ID NO: 598)

Allatotropin, Mas-AT
GFKNVEMMTARGF-NH2  (SEQ ID NO: 599)

{Ala16,17,20}-beta-Amyloid (1-28)
DAEFRHDSGYEVHHQAAVFAAEDVGSN  (SEQ ID NO: 600)

{Gln22}-beta-Amyloid (15-23)
QKLVFFAQD  (SEQ ID NO: 601)

{NMeG24, NMeI26} Human Islet Amyloid Polypeptide (IAPP) (22-27)
NF-(NMe-G)-A-(NMe-I)-L  (SEQ ID NO: 602)

Amylin (1-13), human
KCNTATCATQRLA (Disulfide bridge: 2-7)  (SEQ ID NO: 603)

Amylin (1-37), human
KCNTATCATQRLANFLVHSSNNFGAILSSTNVGSNTY (Disulfide bridge: 2-7)  (SEQ ID NO: 604)

Amylin (20-29), human
SNNFGAILSS  (SEQ ID NO: 605)

Amylin (8-37), human
ATQRLANFLVHSSNNFGAILSSTNVGSNTY-NH2  (SEQ ID NO: 606)

Beta-Amyloid (12-24)
VHHQKLVFFAEDV  (SEQ ID NO: 607)

TABLE 4-continued

Targets from which the Analogs are derived

Beta-Amyloid (13-23)
HHQKLVFFAED (SEQ ID NO: 608)

Beta-Amyloid (7-29)
DSGYEVHHQKLVFFAEDVGSNKG (SEQ ID NO: 609)

Angiotensin
{Des-Asp1}-Angiotensin 1, human
RVYIHPFHL (SEQ ID NO: 610)

{Sar1, Ala8}-Angiotensin II
Sar-RVYIHPA (SEQ ID NO: 611)

{Sar1, Val5, Ala8}-Angiotensin II, Saralasin
Sar-RVYVHPA (SEQ ID NO: 612)

Angiotensin Converting Enzyme Inhibitor, BPP 9a
Pyr-WPRPQIPP

Angiotensin I Converting Enzyme 2, ACE-2/Caspase-1 Substrate
Mca-YVADAPK(Dnp) (SEQ ID NO: 613)

Angiotensin I, human
DRVYIHPFHL (SEQ ID NO: 614)

Angiotensin II Antipeptide
EGVYVHPV (SEQ ID NO: 615)

Angiotensin I/II (3-8)
VYIHPF (SEQ ID NO: 616)

Angiotensin I/II (4-8)
YIHPF (SEQ ID NO: 617)

Angiotensin I/II (5-8)
IHPF (SEQ ID NO: 618)

Angiotensin II Substrate
DRV-pY-IHPF (SEQ ID NO: 619)

Angiotensin II, human
DRVYIHPF (SEQ ID NO: 620)

Angiotensin III
RVYIHPF (SEQ ID NO: 621)

Prorenin Peptide (33-42)
RIFLKRMPSI (SEQ ID NO: 622)

Renin Substrate, human
DRVYIHPFHLVIHN (SEQ ID NO: 623)

Renin Inhibitor III
RRPFH-Sta-IHK-NH2 (SEQ ID NO: 624)

Annexin 1 (ANXA-1, Ac 2-12)
Ac-AMVSEFLKQAW (SEQ ID NO: 625)

Anti-Inflammatory Peptide 1
MQMKKVLDS (SEQ ID NO: 626)

Anti-Inflammatory Peptide 2
HDMNKVLDL (SEQ ID NO: 627)

Anti-Inflammatory Peptide 3
MQMKKVLDS (SEQ ID NO: 628)

Interleukin-6 Receptor Peptide
TSLPVQDSSSVP (SEQ ID NO: 629)

WP9QY, TNF-alpha Antagonist
YCWSQYLCY (Disulfide bridge: between amino acid numbesr between 2 8)

{Ala13}-Apelin-13
QRPRLSHKGPMPA (SEQ ID NO: 630)

{Phe17}-Apelin 17
KFRRQRPRLSHKGPMPF (SEQ ID NO: 631)

TABLE 4-continued

Targets from which the Analogs are derived

{Pyr1}-Apelin-13
Pyr-RPRLSHKGPMPF-OH  (SEQ ID NO: 632)

Apelin 12
RPRLSHKGPMPF  (SEQ ID NO: 633)

Apelin-15 (63-75)
RRQRPRLSHKGPM  (SEQ ID NO: 634)

Apelin-16, human, bovine
FRRQRPRLSHKGPMPF  (SEQ ID NO: 635)

Apelin-36, human
LVQPRGSRNGPGPWQGGRRKFRRQRPRLSHKGPMPF  (SEQ ID NO: 636)

Bak BH3, Bcl2 (72-87)
KGGGQVGRQLAIIGDDINR  (SEQ ID NO: 637)

Bcl 9-2
GSEGLSKEQLEHRERSLQTLRDIERLLLRSGETEPFLKGPPGGAG-NH2

PR39, Anti-Apoptotic Factor
RRRPRPPYLPRPRPPPFFPPRLPPRIPPGFPPRFPPRFP  (SEQ ID NO: 638)

Proapoptotic Peptide, (klaklak)2
klaklakklaklak-NH2, wherein all amino acid residues are D-amino acid residues  (SEQ ID NO: 639)

PUMA BH3
EEQWAREIGAQLRRMADDLNAQYER  (SEQ ID NO: 640)

RGD-targeted Proapoptotic Peptide
ACDCRGDCFC-GG-klaklakklaklak-NH2 (S—S bonded C1-C4 & C2-C3)  (SEQ ID NO: 641)

26Rfa, Hypothalamic Peptide, human
TSGPLGNLAEELNGYSRKKGGFSFRF-NH2  (SEQ ID NO: 642)

Catch-Relaxing Peptide (CARP)
AMPMLRL-NH2  (SEQ ID NO: 643)

Neuropeptide AF (hNPAF), Human
AGEGLNSQFWSLAAPQRF-NH2  (SEQ ID NO: 644)

NPSF (1-37), Neuropeptide SF (1-37)
SLNFEELKDWGPKNVIKMSTPAVNKMPHSFANLPLRF-NH2  (SEQ ID NO: 645)

AKH/RPCH family of arthropod neuropeptides
LOCUST (AKH-I): pELNFTPNWGT  (SEQ ID NO: 646)
CARAUSIUS (HTF-II): pELTFTPNWGT  (SEQ ID NO: 647)
SYNTHETIC: LTFTPNWGT  (SEQ ID NO: 648)
SYNTHETIC: pELTFTPNWG  (SEQ ID NO: 649)

Mandauca/Heliothis (AKH)
pELTFTSSWG

CRUSTACEAN (RPCH)
pELNFSPGW  (SEQ ID NO: 650)

LOCUSTA (AKH-II)
pELNFSAGW  (SEQ ID NO: 651)

SCHISTOCERCA
pELNFSTGW  (SEQ ID NO: 652)

PERIPLANETA M-I
pEVNFSPNW  (SEQ ID NO: 653)

PERIPLANETA M-II
pELTFTPNW  (SEQ ID NO: 654)

NEUPHOETA/BLABERUS HTH
pEVNFSPGWT  (SEQ ID NO: 655)

ROMALEA-I
pEVNFTPNWGT  (SEQ ID NO: 656)

ROMALEA-II/Gryllus
pEVNFSAGW  (SEQ ID NO: 657)

TABLE 4-continued

Targets from which the Analogs are derived insulin receptor substrate 1 {Homo sapiens}
>gi|5031805|ref|NP_005535.1|insulin receptor substrate 1 {Homo sapiens}
MASPPESDGFSDVRKVGYLRKPKSMHKRFFVLRAASEAGGPARLEYYENEKKWRHKSSAPK
RSIPLESCFNINKRADSKNKHLVALYTRDEHFAIAADSEAEQDSWYQALLQLHNRAKGHHD
GAAALGAGGGGGSCSGSSGLGEAGEDLSYGDVPPGPAFKEVWQVILKPKGLGQTKNLIGIYR
LCLTSKTISFVKLNSEAAAVVLQLMNIRRCGHSENFFFIEVGRSAVTGPGEFWMQVDDSVVA
QNMHETILEAMRAMSDEFRPRSKSQSSSNCSNPISVPLRRHHLNNPPPSQVGLTRRSRTESITA
TSPASMVGGKPGSFRVRASSDGEGTMSRPASVDGSPVSPSTNRTHAHRHRGSARLHPPLNHS
RSIPMPASRCSPSATSPVSLSSSSTSGHGSTSDCLFPRRSSASVSGSPSDGGFISSDEYGSSPCDF
RSSFRSVTPDSLGHTPPARGEEELSNYICMGGKGPSTLTAPNGHYILSRGGNGHRCTPGTGLG
TSPALAGDEAASAADLDNRFRKRTHSAGTSPTITHQKTPSQSSVASIEEYTEMMPAYPPGGGS
GGRLPGHRHSAFVPTRSYPEEGLEMHPLERRGGHHRPDSSTLHTDDGYMPMSPGVAPVPSG
RKGSGDYMPMSPKSVSAPQQIINPIRRHPQRVDPNGYMMMSPSGGCSPDIGGGPSSSSSSSNA
VPSGTSYGKLWTNGVGGHHSHVLPHPKPPVESSGGKLLPCTGDYMNMSPVGDSNTSSPSDC
YYGPEDPQHKPVLSYYSLPRSFKHTQRPGEPEEGARHQHLRLSTSSGRLLYAATADDSSSSTS
SDSLGGGYCGARLEPSLPHPHHQVLQPHLPRKVDTAAQTNSRLARPTRLSLGDPKASTLPRA
REQQQQQQPLLHPPEPKSPGEYVNIEFGSDQSGYLSGPVAFHSSPSVRCPSQLQPAPREEETGT
EEYMKMDLGPGRRAAWQESTGVEMGRLGPAPPGAASICRPTRAVPSSRGDYMTMQMSCPR
QSYVDTSPAAPVSYADMRTGIAAEEVSLPRATMAAASSSAASASPTGPQGAAELAAHSSLL
GGPQGPGGMSAFTRVNLSPNRNQSAKVIRADPQGCRRRHSSETFSSTPSATRVGNTVPFGAG
AAVGGGGGSSSSEDVKRHSSASFENVWLRPGELGGAPKEPAKLCGAAGGLENGLNYIDLD
LVKDFKQCPQECTPEPQPPPPPPHQPLGSGESSSTRRSSEDLSAYASISFQKQPEDRQ
(SEQ ID NO: 658)

insulin {Homo sapiens}
>gi|386828|gb|AAA59172.1|insulin {Homo sapiens}
MALWMRLLPLLALLALWGPDPAAAFVNQHLCGSHLVEALYLVCGERGFFYTPKTRREAED
LQVGQVELGGGPGAGSLQPLALEGSLQKRGIVEQCCTSICSLYQLENYCN
(SEQ ID NO: 659)

ACTIVE (human) INSULIN fragment:
Chain A: GIVEQCCTSICSLYQLENYCN    (SEQ ID NO: 660)
Chain B: FVNQHLCGSHLVEALYLVCGERGFFYTPKT    (SEQ ID NO: 661)
(Modifications: Disulfide bridge between amino acid numbers 6-11, 7-7*, 20-19*)

Insulin Glargine
>A chain
GIVEQCCTSICSLYQLENYCG    (SEQ ID NO: 662)
>B chain
FVNQHLCGSHLVEALYLVCGERGFFYTPKTRR    (SEQ ID NO: 666)
In some embodiments the C-terminus is amidated. In some embodiments the N terminus is acylated.

Insulin Lispro
>A chain
GIVEQCCTSICSLYQLENYCN    (SEQ ID NO: 670)
>B chain
FVNQHLCGSHLVEALYLVCGERGFFYTKPT    (SEQ ID NO: 673)
In some embodiments the C-terminus is amidated. In some embodiments the N terminus is acylated.

Insulin Aspart
>A chain
GIVEQCCTSICSLYQLENYCN
>B chain
FVNQHLCGSHLVEALYLVCGERGFFYTDKT    (SEQ ID NO: 677)
In some embodiments the C-terminus is amidated. In some embodiments the N terminus is acylated.

Oxyntomodulin
>gi|125987831|sp|P01275.3|
MKSIYFVAGLFVMLVQGSWQRSLQDTEEKSRSFSASQADPLSDPDQMNEDKRHSQGTFTSD
YSKYLDSRRAQDFVQWLMNTKRNRNNIAKRHDEFERHAEGTFTSDVSSYLEGQAAKEFIAW
LVKGRGRRDFPEEVAIVEELGRRHADGSFSDEMNTILDNLAARDFINWLIQTKITDRK Oxm
HisSerGlnGlyThrPheThrSerAspTyrSerLysTyrLeuAspSerArgArgAlaGlnAspPheValGlnTrpLeuMetAsn
ThrLysArgAsnArgAsnAsnIleAla
(SEQ ID NO: 681)

DHis1-Oxm
dHisSerGlnGlyThrPheThrSerAspTyrSerLysTyrLeuAspSerArgArgAlaGlnAspPheValGlnTrpLeuMet
AsnThrLysArgAsnArgAsnAsnIleAla
(SEQ ID NO: 682)

Ala2-Oxm
HisAlaGlnGlyThrPheThrSerAspTyrSerLysTyrLeuAspSerArgArgAlaGlnAspPheValGlnTrp
LeuMetAsnThrLysArgAsnArgAsnAsnIleAla
(SEQ ID NO: 683)

TABLE 4-continued

Targets from which the Analogs are derived

DHis1-Ala2-Oxm
dHisAlaGlnGlyThrPheThrSerAspTyrSerLysTyrLeuAspSerArgArgAlaGlnAspPheValGlnTrpLeuMet
AsnThrLysArgAsnArgAsnAsnIleAla
(SEQ ID NO: 684)

Oxm(ex15-18)
HisSerGlnGlyThrPheThrSerAspTyrSerLysTyrLeuGluGluGluAlaAlaGlnAspPheValGlnTrp
LeuMetAsnThrLysArgAsnArgAsnAsnIleAla
(SEQ ID NO: 686)

Oxm(ex15-21)
HisSerGlnGlyThrPheThrSerAspTyrSerLysTyrLeuGluGluGluAlaValArgLeuPheValGlnTrp
LeuMetAsnThrLysArgAsnArgAsnAsnIleAla
(SEQ ID NO: 687)

Oxm(ex15-23)
HisSerGlnGlyThrPheThrSerAspTyrSerLysTyrLeuGluGluGluAlaValArgLeuPheIleGlnTrp
LeuMetAsnThrLysArgAsnArgAsnAsnIleAla
(SEQ ID NO: 688)

Oxm(ex15-24)
HisSerGlnGlyThrPheThrSerAspTyrSerLysTyrLeuGluGluGluAlaValArgLeuPheIleGluTrp
LeuMetAsnThrLysArgAsnArgAsnAsnIleAla
(SEQ ID NO: 689)

Oxm(ex27-33)
HisSerGlnGlyThrPheThrSerAspTyrSerLysTyrLeuAspSerArgArgAlaGlnAspPheValGlnTrp
LeuLysAsnGlyGlyProSerSerAsnAsnIleAla
(SEQ ID NO: 690)

Oxm(ex29-33)
HisSerGlnGlyThrPheThrSerAspTyrSerLysTyrLeuAspSerArgArgAlaGlnAspPheValGlnTrp
LeuMetAsnGlyGlyProSerSerAsnAsnIleAla
(SEQ ID NO: 691)

Oxm(ex30-33)
HisSerGlnGlyThrPheThrSerAspTyrSerLysTyrLeuAspSerArgArgAlaGlnAspPheValGlnTrp
LeuMetAsnThrGlyProSerSerAsnAsnIleAla
(SEQ ID NO: 692)

Oxm(ex27-30) His Ser Gln Gly Thr Phe Thr Ser Asp Tyr Ser Lys Tyr Leu Asp Ser Arg Arg Ala
Gln Asp Phe Val Gln Trp Leu Lys Asn Gly Gly Arg Asn Arg Asn Asn Ile Ala
(SEQ ID NO: 693)

Oxm19-37 AlaGlnAspPheValGlnTrpLeuMetAsnThrLysArgAsnArgAsnAsnIleAla
(SEQ ID NO: 694)

Oxm30-37 LysArgAsnArgAsnAsnIleAla
(SEQ ID NO: 695)

Oxm-Ala38
HisSerGlnGlyThrPheThrSerAspTyrSerLysTyrLeuAspSerArgArgAlaGlnAspPheValGlnTrpLeuMet
AsnThrLysArgAsnArgAsnAsnIleAlaAla
(SEQ ID NO: 698)

Oxm-Ala38,39
HisSerGlnGlyThrPheThrSerAspTyrSerLysTyrLeuAspSerArgArgAlaGlnAspPheValGlnTrp
LeuMetAsnThrLysArgAsnArgAsnAsnIleAlaAlaAla
(SEQ ID NO: 699)

Oxm-Ala38-42
HisSerGlnGlyThrPheThrSerAspTyrSerLysTyrLeuAspSerArgArgAlaGlnAspPheValGlnTrp
LeuMetAsnThrLysArgAsnArgAsnAsnIleAlaAlaAlaAlaAlaAla
(SEQ ID NO: 700)

Oxm-Lys38-Laur
HisSerGlnGlyThrPheThrSerAspTyrSerLysTyrLeuAspSerArgArgAlaGlnAspPheValGlnTrp
LeuMetAsnThrLysArgAsnArgAsnAsnIleAla(LysLAUROYL)
(SEQ ID NO: 701)

Oxm-Lys38-Palm
HisSerGlnGlyThrPheThrSerAspTyrSerLysTyrLeuAspSerArgArgAlaGlnAspPheValGlnTrp
LeuMetAsnThrLysArgAsnArgAsnAsnIleAla(LysPALMITOYL)
(SEQ ID NO: 702)

TABLE 4-continued

Targets from which the Analogs are derived

Oxm-Ala38,39-Lys40Laur
HisSerGlnGlyThrPheThrSerAspTyrSerLysTyrLeuAspSerArgArgAlaGlnAspPheValGlnTrpLeuMet
AsnThrLysArgAsnArgAsnAsnIleAlaAlaAla(LysLAUROYL)
(SEQ ID NO: 703)

Oxm-Ala38,39-Lys40Palm
HisSerGlnGlyThrPheThrSerAspTyrSerLysTyrLeuAspSerArgArgAlaGlnAspPheValGlnTrpLeuMet
AsnThrLysArgAsnArgAsnAsnIleAlaAlaAla(LysPALMITOYL)-(D-His1)-Ala2-
(SEQ ID NO: 704)

Oxm(ex15-23)
dHisAlaGlnGlyThrPheThrSerAspTyrSerLysTyrLeuGluGluGluAlaValArgLeuPheIleGlnTrpLysAsn
GlyGlyProSerSerArgAsnAsnIleAlaAlaAla(LysLAUROYL)(ex27-33)-Ala38,39-Lys40-LAUROYL
(SEQ ID NO: 705)

MC-4R Agonist (Cyclo (β-Ala-His-D-Phe-Arg-Trp-Glu)-NH₂)
Ac-Nle-Asp-His-D-Tyr-Arg-Trp-Lys-NH₂  (SEQ ID NO: 706)
Ac-Lys-Tyr-Val-Nle-Gly-His-Phe-Arg-Trp-Asp-Arg-Phe-Gly-NH₂  (SEQ ID NO: 707)
Ac-Ser Tyr Ser Met Glu His Phe Arg Trp Gly Lys Pro Val NH₂  (SEQ ID NO: 709)

Biotin-β-Endomorphin, human
Biotin-YGGFMTSEKSQTPLVTLFKNAIIKNAYKKGE  (SEQ ID NO: 710)

{Ala1,3,11,16}-Endothelin 1, human
ASASSLMDKEAVYFAHLDIIW  (SEQ ID NO: 712)

Big Endothelin-1 (1-38), human
CSCSSLMDKECVYFCHLDIIWVNTPEHVVPYGLGSPRS  (Disulfide bridge: I-15 and 3-11)

Endothelin 1, human, porcine
CSCSSLMDKECVYFCHLDIIW  (Disulfide bridge: I-15 and 3-11  (SEQ ID NO: 713)

Endothelin 2, human
CSCSSWLDKECVYFCHLDIIW  (Disulfide bridge: I-15 and 3-11)  (SEQ ID NO: 714)

Orphanin FQ2, (OFQ2, NOCII)
FSEFMRQYLVLSMQSSQ  (SEQ ID NO: 715)

{Des-His1, Glu8}-Exendin-4
GEGTPTSELSKQMEEEAVRLPIEWLKNGGPSSGAPPPS-NH2  (SEQ ID NO: 716)

Biotin-Exendin 4
Biotin-HGEGTFTSDLSKQMEEEAVRLFIEWLKNGGPSSGAPPPS-NH2  (SEQ ID NO: 717)

Exendin (10-39)
LSKQMEEEAVRLFIEWLKNGGPSSGAPPPS-NH2  (SEQ ID NO: 718)

Exendin (4-39)
GTFTSDLSKQMEEEAVRLFIEWLKNGGPSSGAPPPS-NH2  (SEQ ID NO: 719)

Exendin (5-39)
TFTSDLSKQMEEEAVRLFIEWLKNGGPSSGAPPPS-NH2  (SEQ ID NO: 720)

Exendin (7-39)
TSDLSKQMEEEAVRLFIEWLKNGGPSSGAPPPS-NH2  (SEQ ID NO: 721)

Exendin (9-39)
DLSKQMEEEAVRLFIEWLKNGGPSSGAPPPS-NH2  (SEQ ID NO: 722)

Exendin (9-39)
DLSKQMEEEAVRLFIEWLKNGGPSSGAPPPS-NH2  (SEQ ID NO: 723)

Exendin 3
HSDGTFTSDLSKQMEEEAVRLFIEWLKNGGPSSGAPPPS-NH2  (SEQ ID NO: 724)

Glicentin-Related Peptide (21-50), human RSLQDTEEKSRSFSASQADPLSDPDQMNED-NH2  (SEQ ID NO: 725)

α1(I) Collagen (614-639), Type I Collagen α1(I) C-Telopeptide, human
SAGFDFSFLPQPPQEKAHDGGRYYRA  (SEQ ID NO: 726)

FDC-SP (30-85), human
SISDSDELASGFFVFPYPYPFRPLPPIPFPRFPWFRRNFPIPIPESAPTTPLPSEK  (SEQ ID NO: 727)

FDC-SP (61-85), human
FPWFRRNFPIPIPESAPTTPLPSEK  (SEQ ID NO: 728)

TABLE 4-continued

Targets from which the Analogs are derived

Fibrinopeptide A, human
ADSGEGDFLAEGGGVR  (SEQ ID NO: 729)

Fibrinopeptide B, human
Pyr-GVNDNEEGFFSAR  (SEQ ID NO: 730)

Gamma-Fibrinogen (377-395)
YSMKETTMKIIPFNRLSIG  (SEQ ID NO: 731)

{Glu1}-Fibrinopeptide B Glufib
EGVNDNEEGFFSAR  (SEQ ID NO: 732)

EAK16-II
AEAEAKAKAEAEAKAK-NH2  (SEQ ID NO: 733)

Elastin-Like Octapeptide
GVGVPGVGVPGVGVPGVG  (SEQ ID NO: 734)

Fibrinogen β-Chain (24-42)
EEAPSLRPAPPPISGGGYR  (SEQ ID NO: 735)

Fibrinogen γ-Chain (117-133)
NNQKIVNLKEKVAQLEA  (SEQ ID NO: 736)

Fibrinogen γ-Chain (397-411)
GQQHHLGGAKQAGDV  (SEQ ID NO: 737)

Fibrinogen Binding Inhibitor Peptide
HHLGGAKQAGDV  (SEQ ID NO: 738)

Fibrinogen-Binding Peptide
EHIPA  (SEQ ID NO: 739)

{Ala6,D-Trp8}-Galanin (1-15)-ol
GWTLNAAwYLLGPHA-ol  (SEQ ID NO: 740)

{D-Trp6,8,9}-Galanin (1-15)-ol
GWTLNwAwwLLGPHA-ol  (SEQ ID NO: 741)

Biotin-Galanin, human
Biotin-GWTLNSAGYLLGPHAVGNHRSFSDKNGLTS  (SEQ ID NO: 742)

Biotin-Galanin, human
Biotin-GWTLNSAGYLLGPHAVGNHRSFSDKNGLTS

Galanin (1-13)-Bradykinin (2-9), amide, M35
GWTLNSAGYLLGPPPGFSPFR-NH2  (SEQ ID NO: 743)

Galanin (1-13)-Neuropeptide Y (25-36), amide, M32
GWTLNSAGYLLGPRHYINLITRQRY-NH2  (SEQ ID NO: 744)

Galanin (1-13)-Pro-Pro-(Ala-Leu)2-Ala, amide
GWTLNSAGYLLGPPPALALA-NH2  (SEQ ID NO: 745)

Galanin (1-13)-Spantide I, C7
GWTLNSAGYLLGPrPKPQQwFwLL-NH2  (SEQ ID NO: 746)

Galanin (1-13)-Spantide I, C8
GWTLNSAGYLLGPrPKPQQwFwLL-NH2  (SEQ ID NO: 747)

Galanin (1-13)-Substance P (5-11), amide, Galantide
GWTLNSAGYLLGPQQFFGLM-NH2  (SEQ ID NO: 748)

Galanin (1-13)/Galanin Like Peptide (GALP) (9-21), common
GWTLNSAGYLLGP  (SEQ ID NO: 749)

Galanin Message Associated Peptide, GMAP (1-41), amide
ELEPEDEARPGGFDRLQSEDKAIRTIMEFLAFLHLKEAGAL-NH2  (SEQ ID NO: 750)

Galanin Message Associated Peptide, GMAP (16-41), amide
LQSEDKAIRTIMEFLAFLHLKEAGAL-NH2  (SEQ ID NO: 751)

Galanin Message Associated Peptide, GMAP (25-41), amide
TIMEFLAFLHLKEAGAL-NH2  (SEQ ID NO: 752)

Galanin Message Associated Peptide, GMAP (44-59), amide
LPGLPSAASSEDAGQS-NH2  (SEQ ID NO: 753)

TABLE 4-continued

Targets from which the Analogs are derived

Galanin, human
GWTLNSAGYLLGPHAVGNHRSFSDKNGLTS

Galanin-Lys(Biotin), human
GWTLNSAGYLLGPHAVGNHRSFSDKNGLTSK(Biotin)   (SEQ ID NO: 754)

Galanin-Lys(Biotin), human, FAM-labeled
FAM-GWTLNSAGYLLGPHAVGNHRSFSDKNGLTSK(Biotin)

Leptin (57-74)
VTGLDFIPGLHPILTLSK   (SEQ ID NO: 755)

GIP (1-42), human
YAEGTFISDYSIAMDKIHQQDFVNWLLAQKGKKNDWKHNITQ

GIP (3-42), human
EGTFISDYSIAMDKIHQQDFVNWLLAQKGKKNDWKHNITQ   (SEQ ID NO: 756)

(Leu15)-Gastrin-1, human
Pyr-GPWLEEEEEAYGWLDF-NH2   (SEQ ID NO: 757)

Big Gastrin-1, human
Pyr-LGPQGPPHLVADPSKKQGPWLEEEEEAYGWMDF-NH2   (SEQ ID NO: 758)

Biotin-Gastrin (1-17)
Biotin-EGPWLEEEEEAYGWMDF-NH2   (SEQ ID NO: 759)

Biotin-Gastrin (1-17), phosphorylated
Biotin-EGPWLEEEEEA-pY-GWMDF-NH2   (SEQ ID NO: 760)

Biotin-Gastrin Releasing Peptide, human
Biotin-VPLPAGGGTVLTKMYPRGNHWAVGHLM-NH2   (SEQ ID NO: 761)

Gastrin derived peptide
GPWLEEEEEAYGWMDFK-NH2   (SEQ ID NO: 762)

Gastrin Releasing Peptide (14-27), porcine and human
MYPRGNHWAVGHLM-NH2   (SEQ ID NO: 763)

Gastrin Releasing Peptide (20-27), porcine and human, acetylated
Ac-HWAVGHLM-NH2   (SEQ ID NO: 764)

Gastrin Releasing Peptide, human
VPLPAGGGTVLTKMYPRGNHWAVGHLM-NH2   (SEQ ID NO: 765)

Gastrin Releasing Peptide-Lys(Biotin), human
VPLPAGGGTVLTKMYPRGNHWAVGHLMK(Biotin)

Gastrin-1, human
Pyr-GPWLEEEEEAYGWMDF-NH2   (SEQ ID NO: 766)

Gastrin-Releasing Peptide (1-17)
VPLPAGGGTVLTKMYPR   (SEQ ID NO: 767)

GRP10, Gastrin-releasing Peptide 10/Neuromedin C, amidated
GNHWAVGHLM-NH2   (SEQ ID NO: 768

{Des-His1, Glu9}-Glucagon (1-29), amide
SQGTFTSEYSKYLDSRRAQDFVQWLMNT-NH2   (SEQ ID NO: 769)

Glucagon-like Peptide-2, GLP-2 (146-178), human
HADGSFSDEMNTILDNLAARDFINWLIQTKITD Peptide Histidine Isoleucinamide (PHI), Porcine (1-27)
HADGVFTSDFSRLLGQLSAKKYLESLI-NH2   (SEQ ID NO: 770)

Glucagon-Like Peptide 1, GLP-1 (7-17)-Cys
HAEGTFTSDVSC   (SEQ ID NO: 771)

{GalNAc-Ser}-Erythropoietin (Epo) (117-131)
EAISPPDAA-*S-AAPLR (*S = GalNAc-Ser)   (SEQ ID NO: 772)

EGFR-1148, EGFR (1140-1152)
QISLDNPDYQQDF   (SEQ ID NO: 773)

Growth Hormone Releasing Factor, GRF (1-29), amide, human
YADAIFTNSYRKVLGQLSARKLLQDIMSR-NH2   (SEQ ID NO: 774)

TABLE 4-continued

Targets from which the Analogs are derived

Growth Hormone Releasing Factor, GRF (1-40), amide, human
YADAIFTNSYRKVLGQLSARKLLQDIMSRQQGESNQERGA-NH2  (SEQ ID NO: 775)

Growth Hormone Releasing Factor, GRF (1-44), amide, human
YADAIFTNSYRKVLGQLSARKLLQDIMSRQQGESNQERGARARL-NH2  (SEQ ID NO: 776)

{D-Ala2}-Growth Hormone Releasing Factor, GRF (1-29), amide, human
YaDAIFTNSYRKVLGQLSARKLLQDIMSR-NH2  (SEQ ID NO: 777)

PEP1--inhibits membrane association of NS5A, hence impairing HCV replication
SGSWLRDVWDWICTVLTDFKTWLQSKLDYKD-NH2  (SEQ ID NO: 778)

Pep 4A
GSVVIVGRIILSGR-NH2  (SEQ ID NO: 779)

Pep 4AK
KKKGSVVIVGRIILSGR-NH2  (SEQ ID NO: 780)

HMGA N-Terminal Fragment
GAGQPSTSAQGQ  (SEQ ID NO: 781)

AKT/PKB/Rac-Protein Kinase Substrate {ARKRERTYSFGHHA}, Biotinylated
Biotin-ARKRERTYSFGHHA  (SEQ ID NO: 782)

5-TMR-ARKRERTYSFGHHA Competitively inhibits histone H2B phosphorylation (Ki = 12 µM) by AKT
5-TMR-ARKRERTYSFGHHA  (SEQ ID NO: 783)

T20
Ac-YTSLIHSLIEESQNQQEKNEQELLELDKWASLWNWF-NH2  (SEQ ID NO: 784)

T22 ({Tyr5,12, Lys7}-polyphemusin II)
RRWCYRKCYKGYCYRKCR  (SEQ ID NO: 785)

Skeletal Dihydropyridine Receptor (671-690)
TSAQKAKAEERKRRKMSRGL  (SEQ ID NO: 786)

Luteinizing Hormone-Releasing Hormone (LH-RH), human,
Pyr-HWSYGLRPG-NH2  (SEQ ID NO: 787)

β-MSH, human
AEKKDEGPYRMEHFRWGSPPKD  (SEQ ID NO: 788)

γ-2-MSH (41-58)
YVMGHFRWDRFG  (SEQ ID NO: 789)

{D-Phe7}-ACTH, α-MSH (1-13), amide
SYSMEHfRWGKPV-NH2  (SEQ ID NO: 790)

{Nle4, D-Phe7}-α-MSH, amide
Ac-SYS-Nle-EHfRWGKPV-NH2  (SEQ ID NO: 791)

Melanin Concentrating Hormone, human, mouse, rat
DFDMLRCMLGRVYRPCWQV (Disulfide bridge: 7-16)  (SEQ ID NO: 792)

VA-β-MSH, Lipotropin-γ, Proopiomelanocortin-derived
VAAEKKDEGPYRMEHFRWGSPPKD  (SEQ ID NO: 793)

Apolipoprotein B-100 (3136-3155), human
KTTKQSFDLSVKAQYKKNKH  (SEQ ID NO: 794)

alpha-9 Gliadin Peptide
QVLQQSTYQLLQELCCQHLW  (SEQ ID NO: 795)

MOG (8-21)
PGYPIRALVGDEAE  (SEQ ID NO: 796)

MOG (97-108)
TCFFRDHSYQEE  (SEQ ID NO: 797)

MOG (14-39), human
ALVGDEVELPCRISPGKNATGMELGW  (SEQ ID NO: 798)

MOG (50-74), human
LYRNGKDQDGDAPEYRGRTELLKD  (SEQ ID NO: 799)

TABLE 4-continued

Targets from which the Analogs are derived

MOG (27-50), human
SPGKNATGMELGWYRPPFSRVVHL  (SEQ ID NO: 800)

MOG (76-100), human
IGEGKVTLRIRNVRFSDEGGFTCFF  (SEQ ID NO: 801)

MOG (89-113), human
RFSDEGGFTCFFRDHSYQEEAAMEL  (SEQ ID NO: 802)

MOG (35-51)
MEVGWYRSPFSRVVHLY  (SEQ ID NO: 803)

MOG (35-52)
MEVGWYRSPFSRVVHLYR  (SEQ ID NO: 804)

MOG (35-53)
MEVGWYRSPFSRVVHLYRN  (SEQ ID NO: 805)

MOG (35-55), human
MEVGWYRPPFSRVVHLYRNGK  (SEQ ID NO: 806)

MOG (101-120), human, mouse
RDHSYQEEAAMELKVEDPFY  (SEQ ID NO: 807)

{Ala4}-MBP (1-11)
Ac-ASQARPSQRHG  (SEQ ID NO: 808)

{Tyr4}-MBP (1-11)
Ac-ASQYRPSQRHG  (SEQ ID NO: 809)

MBP (1-17)
ASQKRPSQRSKYLATAS  (SEQ ID NO: 810)

MBP (1-20), Myelin Basic Protein (1-20)
ASQKRPSQRSKYLATASTMD  (SEQ ID NO: 811)

MBP (111-129)
LSRFSWGAEGQRPGFGYGG  (SEQ ID NO: 812)

MBP (131-155)
ASDYKSAHKGLKGVDAQGTLSKIFK  (SEQ ID NO: 813)

Vasonatrin Peptide (1-27)
GLSKGCFGLKLDRIGSMSGLGCNSFRY (Disulfide bridge: 6-22)  (SEQ ID NO: 814)

{Ala5, β-Ala8}-Neurokinin A (4-10)
DAFV-(β-A)-LM-NH2  (SEQ ID NO: 815)

{D-Pro2, D-Trp6,8, Nle10}-Neurokinin B
DpHDFwVwL-Nle-NH2  (SEQ ID NO: 816)

{Lys5, NMeLeu9, Nle10}-Neurokinin A (4-10)
DKFVG-(NMeL)-Nle-NH2  (SEQ ID NO: 817)

Neurokinin A, Substance K, Neuromedin L, NKA
HKTDSFVGLM-NH2  (SEQ ID NO: 818)

Neuromedin (B-30)
LSWDLPEPRSRAGKIRVHPRGNLWATGHFM-NH2  (SEQ ID NO: 819)

{Ser2}-Neuromedin C
GSHWAVGHLM-NH2  (SEQ ID NO: 820)

β-Neuroprotectin (D-Ala1)
aDLIAYL-NH2  (SEQ ID NO: 821)

{Ala16,17,20}-beta-Amyloid (1-28)
DAEFRHDSGYEVHHQAAVFAAEDVGSNK  (SEQ ID NO: 822)

26Rfa, Hypothalamic Peptide, human
TSGPLGNLAEELNGYSRKKGGFSFRF-NH2

Brain Neuropeptide I
AGEGLSSPFWSLAAPQRF-NH2  (SEQ ID NO: 823)

Erythropoietin, Human (hEPO) Fragment
MEVGQQAVEVWQGLALLSEAVLR  (SEQ ID NO: 824)

TABLE 4-continued

Targets from which the Analogs are derived

Neuropeptide NPW-23 (Human)
WYKHVASPRYHTVGRAAGLLMGL  (SEQ ID NO: 825)

VGF Protein Precursor (491-507)
PPEPVPPPRAAPAPTHV  (SEQ ID NO: 826)

{Gln4}-Neurotensin
Pyr-LYQNKPRRPYIL  (SEQ ID NO: 827)

{D-Tyr11}-Neurotensin
Pyr-LYENKPRRPyIL  (SEQ ID NO: 828)

{D-Trp11}-Neurotensin
Pyr-LYENKPRRPwIL  (SEQ ID NO: 829)

{D-Phe11}-Neurotensin
Pyr-LYENKPRRPfIL  (SEQ ID NO: 830)

Neurotensin
Pyr-LYENKPRRPYIL  (SEQ ID NO: 831)

Neuropeptide F
PDKDFIVNPSDLVLDNKAALRDYLRQINEYFAIIGRPRF-NH2  (SEQ ID NO: 832)

PTD-p50 (NLS) Inhibitory Peptide
DRQIKIWFQNRRMKWKKVQRKRQKLMP  (SEQ ID NO: 833)

PTD-p65-P1 Peptide
DRQIKIWFQNRRMKWKKQLRRPSDRELSE  (SEQ ID NO: 834)

PTD-p65-P6 (Ser529/536) Inhibitory Peptide
DRQIKIWFQNRRMKWKKNGLLSGDEDFSS  (SEQ ID NO: 835)

PTD-TRAF6 Inhibitory Peptide
DRQIKIFQNRRMKWKKRKIPTEDEY  (SEQ ID NO: 836)

RNase S Complex Peptide
Ac-KETAAAKFERQHMDSSTSA-NH2  (SEQ ID NO: 837)

IKKγ NEMO Binding Domain (NBD) Inhibitory Peptide
DRQIKIWFQNRRMKWKKTALDWSWLQTE  (SEQ ID NO: 838)

{Trp5}-Oryzatensin (5-9), rice
WPLPR  (SEQ ID NO: 839)

LVV-Hemorphin-6, Leu-Valorphin-Arg
LVVYPWTQR  (SEQ ID NO: 840)

LVV-Hemorphin-7
LVVYPWTQRF  (SEQ ID NO: 841)

Nociceptin (1-11), (Orphanin FQ, or OFQ/N) (1-11)
FGGFTGARKSA  (SEQ ID NO: 842)

Nociceptin (1-13), amide
FGGFTGARKSARK  (SEQ ID NO: 843)

Nociceptin (1-7), (Orphanin FQ, or OFQ/N) (1-7)
FGGFTGA  (SEQ ID NO: 844)

Prepronociceptin (169-176), human
TLHQNGNV  (SEQ ID NO: 845)

Serorphin, BSA (399-404)
YGFQNA  (SEQ ID NO: 846)

Valorphin
VVYPWTQ  (SEQ ID NO: 847)

Orexin A, bovine, human, mouse, rat
Pyr-PLPDCCRQKTCSCRLYELLHGAGNHAAGILTL-NH2 (Disulfide bridge: 6-12 and 7-14)  (SEQ ID NO: 848)

Orexin B, human
RSGPPGLQGRLQRLLQASGNHAAGILTM-NH2  (SEQ ID NO: 849)

TABLE 4-continued

Targets from which the Analogs are derived

{Gla17,21,24}-Osteocalcin (1-49)
YLYQWLGAPVPYPDPL-Gla-PRR-Gla-VC-Gla-LNPDCDELDHIGFQEAYRRFYGPV
(Gla = γ-Carboxyglutamic Acid; Disulfide bridge: 23-29)   (SEQ ID NO: 851)

Osteocalcin (37-49), human
GFQEAYRRFYGPV   (SEQ ID NO: 852)

Osteocalcin (7-19), human
GAPVPYPDPLEPR   (SEQ ID NO: 853)

Lys-OVA (257-264), KSIINFEKL
KSIINFEKL   (SEQ ID NO: 854)

{Arg8}-Vasopressin (AVP)
CYFQNCPRG-NH2 (Disulfide bridge: 1-6)   (SEQ ID NO: 855)

{Deamino-Cys1, D-Arg8}-Vasopressin, free acid
3-Mercaptopropionyl-YFQNCPrG (Disulfide bridge: 1-6)   (SEQ ID NO: 856)

Oxytocin
CYIQNCPLG-NH2 (Disulfide bridge: 1-6)   (SEQ ID NO: 857)

Serum Albumin (102-226)
ADDKETCFAEEGKKLVAASQAALGL   (SEQ ID NO: 858)

Apolipoprotein J (215-222)
RPHFFFPK   (SEQ ID NO: 859)

Apolipoprotein L (306-316)
VNEPSILEMSR   (SEQ ID NO: 860)

Catestatin, human
SSMKLSFRARAYGFRGPGPL   (SEQ ID NO: 861)

Pancreastatin (37-52), Human
EEEEEMAVVPQGLFRG-NH2   (SEQ ID NO: 862)

Pancreatic Polypeptide (30-53), human
APLEPVYPGDNATPEQMAQYAADL   (SEQ ID NO: 863)

{Tyr0}-Hypercalcemia Malignancy Factor (1-40)
YAVSEHQLLHDKGKSIQDLRRRFFLHHLIAEIHTAEIRATS   (SEQ ID NO: 864)

Hypercalcemia Malignancy Factor (1-34), (PLP) amide, human
AVSEHQLLHDKGKSIQDLRRRFFLHHLIAEIHTA-NH2   (SEQ ID NO: 865)

TIP 39, Tuberoinfundibular Neuropeptide
SLALADDAAFRERARLLAALERRHWLNSYMHKLLVLDAP   (SEQ ID NO: 866)

PACAP-Related Peptide (PRP), human
DVAHGILNEAYRKVLDQLSAGKHLQSLVA   (SEQ ID NO: 867)

Prolactin Releasing Peptide (1-31), human
SRTHRHSMEIRTPDINPAWYASRGIRPVGRF-NH2   (SEQ ID NO: 868)

Prolactin Releasing Peptide (12-31), human
TPDINPAWYASRGIRPVGRF-NH2   (SEQ ID NO: 869)

Calpain Inhibitor Peptide, B27-WT
DPMSSTYIEELGKREVTIPPKYRELLA   (SEQ ID NO: 870)

105Y, α1-antitrypsin (359-374)
SIPPEVKFNKPFVYLI

Acetyl-Calpastatin (184-210), CS peptide, human
Ac-DPMSSTYIEELGKREVTIPPKYRELLA-NH2   (SEQ ID NO: 871)

{Ala144}-PLP (139-151) A144-PLP(139-151)
HSLGKALGHPDKF   (SEQ ID NO: 872)

PLP (190-209)
SKTSASIGSLCADARMYGVL   (SEQ ID NO: 873)

PLP (48-70)
TYFSKNYQDYEYLINIHAFQYV   (SEQ ID NO: 874)

Acetyl-Tetradecapeptide Renin Substrate, Acetyl-Angiotensinogen (1-14), human
Ac-DRVYIHPFHLVIHN   (SEQ ID NO: 875)

TABLE 4-continued

Targets from which the Analogs are derived

TP508, Thrombin-derived Peptide
AGYKPDEGKRGDACEGDSGGPFV  (SEQ ID NO: 876)

Salusin-alpha
SGALPPAPAAPRPALRAQRAGPAGPGAK-NH2  (SEQ ID NO: 877)

Salusin-beta
AIFIFIRWLLKLGHHGRAPP  (SEQ ID NO: 878)

Prosaptide 769P (D-Ala2)
CaFLVKEVTKLIDNNKTEKEIL  (SEQ ID NO: 879)

Prosaptide TX14(A) (D-Ala2)
TaLIDNNATEEILY  (SEQ ID NO: 880)

Prosaptide, wild type
TKLIDNNKTEKEIL  (SEQ ID NO: 881)

Saposin C12
LIDNNKTEKEIL  (SEQ ID NO: 882)

Saposin C18
VKEVTKLIDNNKTEKEIL  (SEQ ID NO: 883)

Saposin C22
CEFLVKEVTKLIDNNKTEKEIL  (SEQ ID NO: 884)

Secretin, human
HSDGTFTSELSRLREGARLQRLLQGLV-NH2  (SEQ ID NO: 885)

CC Chemokine Receptor 3 Fragment I, amide
MTTSLDTVETFGTTSYYDDVGLLCEKADTR-NH2  (SEQ ID NO: 886)

CC Chemokine Receptor 3 Fragment II
MTTSLDTVETFGTTSYYDDVGLLC  (SEQ ID NO: 887)

DAP10 Signaling Fragment
PAQEDGKVYINMPGRG  (SEQ ID NO: 888)

Erythropoietin-Mimetic Peptide 17 (EMP17)
TYSCHFGPLTWVCKPQGG  (SEQ ID NO: 889)

Hsp Heat shock protein (3-13)
KTIAYDEEARR  (SEQ ID NO: 890)

iNOS (507-531), human
RPKRREIPLKVLVKAVLFACMLMRK  (SEQ ID NO: 891)

Notch 1 (1735-1752)
VLLFFVGCGVLLSRKRRR  (SEQ ID NO: 892)

SmMLCKp, Smooth-Muscle Myosin Light-Chain Kinase (796-815), Calmodulin Binding
ARRKWQKTGHAVRAIGRLSS  (SEQ ID NO: 893)

Tau-Protein (1-16)
MAEPRQEFEVMEDHAG  (SEQ ID NO: 894)

Tau-Protein (323-335)
GSLGNIHHKPGGG  (SEQ ID NO: 895)

Caveolin-1 Scaffolding Domain (82-101)
DGIWKASFTTFTVTKYWFYR  (SEQ ID NO: 896)

Caveolin-3 (Cav-3), (55-74)
DGVWRVSYTTFTVSKYWCYR  (SEQ ID NO: 897)

{Gly35, Asp37}-beta-Amyloid (1-42)
DAEFRHDSGYEVHHQKLVFFAEDVGSNKGAIIGLGVDGVVIA  (SEQ ID NO: 898)

{Cys7}-beta-Amyloid (1-40)
DAEFRHCSGYEVHHQKLVFFAEDVGSNKGAIIGLMVGGVV  (SEQ ID NO: 899)

beta-Amyloid (1-40)
DAEFRHDSGYEVHHQKLVFFAEDVGSNKGAIIGLMVGGVV  (SEQ ID NO: 900)

{Cys3,6, Tyr8, Pro9}-Substance P
RPCPQCFYPLM-NH2 (Disulfide bridge: 3-6)  (SEQ ID NO: 901)

TABLE 4-continued

Targets from which the Analogs are derived

{4-Chloro-Phe}7,8-Substance P
RPKPQQ-F(4-Cl—F)-GLM-NH2 (SEQ ID NO: 902)

{Cys3,6, Tyr8, Pro10}-Substance P
RPCPQCFYGPM-NH2 (Disulfide bridge: 3-6) (SEQ ID NO: 903)

Ranakinin
KPNPERFYGLM-NH2 (SEQ ID NO: 904

Scyliorhinin I, Scy I, Shark Substance P Related Peptide
AKFDKFYGLM (SEQ ID NO: 905)

Substance P
RPKPQQFFGLM-NH2 (SEQ ID NO: 906)

SFLLRNPNDKYEPF, human Thrombin Receptor 42-55
SFLLRNPNDKYEPF (SEQ ID NO: 907)

Tumor Necrosis Factor Receptor, TNFR (159-178) Analog
QEKQNTVATAHGFFLRENEG (SEQ ID NO: 908)

CDIP2
KISLQRLKSYVITTSRCPQ (SEQ ID NO: 909)

Pro-TNF-α (71-82), human
SPLAQAVRSSSR (SEQ ID NO: 910)

TNF-α (10-36), human
DKPVAHVVANPQAEGQLQWLNRRANAL (SEQ ID NO: 911)

TNF-α (31-45), human
RRANALLANGVELRD (SEQ ID NO: 912)

Brevinin-2Eg
GIMDTLKNLAKTAGKGALQSLLNHASCKLSGQC (Disulfide bridge 27-33) (SEQ ID NO: 913)

Brevinin-2Eh
GIMDTLKNLAKTAGKGALQSLLNHASCKLSKQC (Disulfide bridge 27-33) (SEQ ID NO: 914)

Caloxin 1b1
TAWSEVLHLLSRGGG (SEQ ID NO: 915)

Caloxin 2A1
VSNSNWPSFPSSGGG (SEQ ID NO: 916)

Caloxin 3A1
WSSTSSVSAPLEFGGGGSAK (SEQ ID NO: 917)

Delta-Toxin (1-26), Staphylococcus aureus
MAQDIISTIGDLVKWIIDTVNKFTKK (SEQ ID NO: 918)

Delta-Toxin (5-20), Staphylococcus aureus
IISTIGDLVKWIIDTV (SEQ ID NO: 919)

Sarafotoxin 6c
CTCNDMTDEECLNFCHQDVIW (Disulfide bridge: 1-15 and 3-11) (SEQ ID NO: 920)

Vesicle-Associated Membrane Protein, VAMP (60-94)
LSELDDRADALQAGASQFETSAAKLKRKYWWKNLK (SEQ ID NO: 921)

Vesicle-Associated Membrane Protein, VAMP (77-94)
SQFETSAAKLKRKYWWKNLK (SEQ ID NO: 922)

Helodermin
HSDAIFTQQYSKLLAKLALQKYLASILGSRTSPPP (SEQ ID NO: 923)

highly selective CRF$_2$ receptor antagonist K41498
dFHLLRKNleIEIEKQEKEKQQAANNRLLLDTI-NH2 (SEQ ID NO: 924)

Corticotropin-releasing factor receptor antagonist
DLTFHLLREMLEMAKAEQEAEQAALNRLLLEEA-NH2 (SEQ ID NO: 925)

Astressin CAS No: {170809-51-5}
Potent corticotropin-releasing factor (CRF) receptor antagonist ($K_i$ values are 2, 1.5 and 1 nM
at CRF$_1$, CRF$_2$α and CRF$_2$β). Reduces ACTH secretion, blocks delayed gastric emptying and
is neuroprotective in vivo.

TABLE 4-continued

Targets from which the Analogs are derived dFHLLREVLENleARAEQLAQE*AHKg*NRKLNleEII-NH2 E*-Kg* are cyclized. The
cyclic structure has been fixed by amide bond between gamma-COOH group of glutamic
acid and alpha-NH2 group of glycine coupled to the epsilon-NH2 group of lysine. (SEQ ID NO: 926)

Stressin I
Potent and selective corticotropin releasing factor receptor-1 (CRF$_1$) agonist (K$_I$ values are
1.5 and 224 nM for CRF$_1$ and CRF$_2$ receptors respectively). Increases ACTH levels and
increases faecal pellet output in vivo following i.p. administration.
Ac-PPISLDLTFHLLREVLENleARAEQLAQQE*HSK*AKLNleEII-NH2 E*-K* are
cyclized. The cyclic structure has been fixed by amide bond between gamma-COOH group
of glutamic acid and epsilon-NH2 group of lysine. (SEQ ID NO: 927)

Human urocortin III-like sequences
MLMPVHFLLLLLLLLGGPRTGLPHKFYKAKPIFSCLNTALSEAEKGQWEDASLLSKR
SFHYLRSRDASSGEEEEGKEKKTFPISGARGGAGGTRYRYVSQAQPRGKPRQDTAKS
PHRTKFTLSLDVPTNIMNLLFNIAKAKNLRAQAAANAHLMAQIGRKK
(SEQ ID NO: 928)

Active Form: 120-137 urocortin III {Homo sapiens}
FTLSLDVPTNIMNLLFNI
FTLSLDVPTNIMNLLFNIAKAKNLRAQAAANAHLMAQI  (SEQ ID NO: 929)

Human urocortin-2
IVLSLDVPIGLLQILLEQARARAAREQATTNARILARV  (SEQ ID NO: 930)

Human Growth Hormone Releasing Factor (GHRF), GRF
YADAIFTNSYRKVLGQLSARKLLQDIMSR-NH2

JI-22 {Dat1, Orn12,21, Abu15, Nle27, Agm29} GHRF-(1-29)
JI-34 {Dat1, Orn12,21,Abu15,Nle27, Asp28, Agm29} GHRF-(1-29)
JI-36 {Dat1, Thr8, Orn12,21, Abu15,Nle27,Asp28,Agm29} GHRF-(1-29)
JI-38 {Dat1,Gln8, Orn12,21,Abu15,Nle27,Asp28,Agm29} GHRF-(1-29)
Dat = desaminotyrosine
Agm = agmatine α-CGRP (human)
ACDTATCVTHRLAGLLSRSGGVVKNNFVPTNVGSKAF-NH2
Optional Disulfide bridge between C2 and C7

CGRP (rat)
SCNTATCVTHRLAGLLSRSGGVVKDNFVPTNVGSEAF-NH2  (SEQ ID NO: 931)
Optional Disulfide bridge between C2 and C7

PTHrP (Human) 1-37
AVSEHQLLHDKGKSIQDLRRFFLHHLIAEIHTAEIR  (SEQ ID NO: 932)

PTH (human) 1-34
SVSEIQLMHNLGKHLNSMERVEWLRKKLQDVHN  (SEQ ID NO: 933)

TIP 39, Tuberoinfundibular Neuropeptide (human)
SLALADDAAFRERARLLAALERRHWLNSYMHKLLVLDAP  (SEQ ID NO: 934)

TIP 39, Tuberoinfundibular Neuropeptide (mouse)
SLALADDAAFRERARLLAALERRRWLDSYMQKLLLLDAP PTH2 Agonists
{His5}-PTH 1-34 (human)
{Ile5}-PTHrP 1-36
{Ile5,Trp23}-PTHrP 1-36 (human)
{Ile5,Trp23}-PTHrP 2-36 (human)
{Ile5,Trp23}-PTHrP 3-36 (human)
{Ile5,Trp23}-PTHrP 4-36 (human)
{Ile5,Trp23}-PTHrP 5-36 (human)
{Ile5,Trp23,Tyr36}-PTHrP 1-36-NH2 (human)
{Phe23}-PTH 1-34 (human)
PTH 1-34 (human)
PTH 1-34 (rat)
PTHrP 1-34
PTHrP 1-36 (human)
{125I} {Nle8,21,Tyr34}-PTH 1-34-NH2 (rat)
TIP39 (human/bovine)
TIP39 (mouse)
{Trp23}-PTHrP 1-36 (human)
{Trp23,Tyr36}-PTHrP 1-36-NH2 (human)

TABLE 4-continued

Targets from which the Analogs are derived

PTH2 Antagonists
{D-Trp12}-PTH 7-34 (bovine
{D-Trp12,Tyr34}-PTH 7-34 (bovine)
{Ile5,Trp23}-PTHrP 5-36
PTHrP 1-21/PTH 22-34
PTHrP 7-34
TIP39 7-39 (human/bovine)
TIP39 7-39 (mouse)

AF 12198
(Potent and selective antagonist for the human type I interleukin-1 (IL-1) receptor)
Ac-FEWTPGWYQXYALPL-NH2   X = 2-Carboxyazetidine   (SEQ ID NO: 935)

human epidermal growth factor
>gi|46242544|gb|AAS83395.1|epidermal growth factor {Homo sapiens}
NSDSECPLSHDGYCLHDGVCMYIEALDKYACNCVVGYIGERCQYRDLKWWELR   (SEQ ID NO: 936)

{cPP1-7,NPY19-23,Ala31,Aib32,Gln34}-hPancreatic Polypeptide
GPSQPTYPGDNATPEQMARYYSALRRYINMAXRQRY-NH2   X = Aib   (SEQ ID NO: 937)

Xenin 8. C-Terminal fragment of xenin, a neurotensin-like peptide; modulates pancreatic insulin and
glucagon secretion/effects.
HPKRPWIL   (SEQ ID NO: 938)

>gi|29725609|ref|NP_005219.2|epidermal growth factor receptor isoform a precursor {Homo
sapiens}
MRPSGTAGAALLALLAALCPASRALEEKKVCQGTSNKLTQLGTFEDHFLSLQRMFNNCEVV
LGNLEITYVQRNYDLSFLKTIQEVAGYVLIALNTVERIPLENLQIIRGNMYYENSYALAVLSN
YDANKTGLKELPMRNLQEILHGAVRFSNNPALCNVESIQWRDIVSSDFLSNMSMDFQNHLGS
CQKCDPSCPNGSCWGAGEENCQKLTKIICAQQCSGRCRGKSPSDCCHNQCAAGCTGPRESD
CLVCRKFRDEATCKDTCPPLMLYNPTTYQMDVNPEGKYSFGATCVKKCPRNYVVTDHGSC
VRACGADSYEMEEDGVRKCKKCEGPCRKVCNGIGIGEFKDSLSINATNIKHFKNCTSISGDLH
ILPVAFRGDSFTHTPPLDPQELDILKTVKEITGFLLIQAWPENRTDLHAFENLEIIRGRTKQHGQ
FSLAVVSLNITSLGLRSLKEISDGDVIISGNKNLCYANTINWKKLFGTSGQKTKIISNRGENSCK
ATGQVCHALCSPEGCWGPEPRDCVSCRNVSRGRECVDKCNLLEGEPREFVENSECIQCHPEC
LPQAMNITCTGRGPDNCIQCAHYIDGPHCVKTCPAGVMGENNTLVWKYADAGHVCHLCHP
NCTYGCTGPGLEGCPTNGPKIPSIATGMVGALLLLLVVALGIGLFMRRRHIVRKRTLRRLLQE
RELVEPLTPSGEAPNQALLRILKETEFKKIKVLGSGAFGTVYKGLWIPEGEKVKIPVAIKELRE
ATSPKANKEILDEAYVMASVDNPHVCRLLGICLTSTVQLITQLMPFGCLLDYVREHKDNIGS
QYLLNWCVQIAKGMNYLEDRRLVHRDLAARNVLVKTPQHVKITDFGLAKLLGAEEKEYHA
EGGKVPIKWMALESILHRIYTHQSDVWSYGVTVWELMTFGSKPYDGIPASEISSILEKGERLP
QPPICTIDVYMIMVKCWMIDADSRPKFRELIIEFSKMARDPQRYLVIQGDERMHLPSPTDSNF
YRALMDEEDMDDVVDADEYLIPQQGFFSSPSTSRTPLLSSLSATSNNSTVACIDRNGLQSCPI
KEDSFLQRYSSDPTGALTEDSIDDTFLPVPEYINQSVPKRPAGSVQNPVYHNQPLNPAPSRDP
HYQDPHSTAVGNPEYLNTVQPTCVNSTFDSPAHWAQKGSHQISLDNPDYQQDFFPKEAKPN
GIFKGSTAENAEYLRVAPQSSEFIGA
(SEQ ID NO: 939)

>gi|41327736|ref|NP_958441.1|epidermal growth factor receptor isoform d precursor {Homo
sapiens}
MRPSGTAGAALLALLAALCPASRALEEKKVCQGTSNKLTQLGTFEDHFLSLQRMFNNCEVV
LGNLEITYVQRNYDLSFLKTIQEVAGYVLIALNTVERIPLENLQIIRGNMYYENSYALAVLSN
YDANKTGLKELPMRNLQEILHGAVRFSNNPALCNVESIQWRDIVSSDFLSNMSMDFQNHLGS
CQKCDPSCPNGSCWGAGEENCQKLTKIICAQQCSGRCRGKSPSDCCHNQCAAGCTGPRESD
CLVCRKFRDEATCKDTCPPLMLYNPTTYQMDVNPEGKYSFGATCVKKCPRNYVVTDHGSC
VRACGADSYEMEEDGVRKCKKCEGPCRKVCNGIGIGEFKDSLSINATNIKHFKNCTSISGDLH
ILPVAFRGDSFTHTPPLDPQELDILKTVKEITGFLLIQAWPENRTDLHAFENLEIIRGRTKQHGQ
FSLAVVSLNITSLGLRSLKEISDGDVIISGNKNLCYANTINWKKLFGTSGQKTKIISNRGENSCK
ATGQVCHALCSPEGCWGPEPRDCVSCRNVSRGRECVDKCNLLEGEPREFVENSECIQCHPEC
LPQAMNITCTGRGPDNCIQCAHYIDGPHCVKTCPAGVMGENNTLVWKYADAGHVCHLCHP
NCTYGPGNESLKAMLFCLFKLSSCNQSNDGSVSHQSGSPAAQESCLGWIPSLLPSEFQLGWG
GCSHLHAWPSASVIITASSCH
(SEQ ID NO: 940)

>gi|41327732|ref|NP_958439.1|epidermal growth factor receptor isoform b precursor {Homo
sapiens}
MRPSGTAGAALLALLAALCPASRALEEKKVCQGTSNKLTQLGTFEDHFLSLQRMFNNCEVV
LGNLEITYVQRNYDLSFLKTIQEVAGYVLIALNTVERIPLENLQIIRGNMYYENSYALAVLSN
YDANKTGLKELPMRNLQEILHGAVRFSNNPALCNVESIQWRDIVSSDFLSNMSMDFQNHLGS
CQKCDPSCPNGSCWGAGEENCQKLTKIICAQQCSGRCRGKSPSDCCHNQCAAGCTGPRESD
CLVCRKFRDEATCKDTCPPLMLYNPTTYQMDVNPEGKYSFGATCVKKCPRNYVVTDHGSC
VRACGADSYEMEEDGVRKCKKCEGPCRKVCNGIGIGEFKDSLSINATNIKHFKNCTSISGDLH
ILPVAFRGDSFTHTPPLDPQELDILKTVKEITGFLLIQAWPENRTDLHAFENLEIIRGRTKQHGQ
FSLAVVSLNITSLGLRSLKEISDGDVIISGNKNLCYANTINWKKLFGTSGQKTKIISNRGENSCK
ATGQVCHALCSPEGCWGPEPRDCVSCRNVSRGRECVDKCNLLEGEPREFVENSECIQCHPEC
LPQAMNITCTGRGPDNCIQCAHYIDGPHCVKTCPAGVMGENNTLVWKYADAGHVCHLCHP
NCTYGS
(SEQ ID NO: 941)

TABLE 4-continued

Targets from which the Analogs are derived

```
>gi|41327734|ref|NP_958440.1|epidermal growth factor receptor isoform c precursor {Homo
sapiens}
MRPSGTAGAALLALLAALCPASRALEEKKVCQGTSNKLTQLGTFEDHFLSLQRMFNNCEVV
LGNLEITYVQRNYDLSFLKTIQEVAGYVLIALNTVERIPLENLQIIRGNMYYENSYALAVLSN
YDANKTGLKELPMRNLQEILHGAVRFSNNPALCNVESIQWRDIVSSDFLSNMSMDFQNHLGS
CQKCDPSCPNGSCWGAGEENCQKLTKIICAQQCSGRCRGKSPSDCCHNQCAAGCTGPRESD
CLVCRKFRDEATCKDTCPPLMLYNPTTYQMDVNPEGKYSFGATCVKKCPRNYVVTDHGSC
VRACGADSYEMEEDGVRKCKKCEGPCRKVCNGIGIGEFKDSLSINATNIKHFKNCTSISGDLH
ILPVAFRGDSFTHTPPLDPQELDILKTVKEITGLS
(SEQ ID NO: 942)
```

PHM 27 (human) Endogenous peptide product of human prepro-VIP and analog of porcine PHI-27;
potent agonist for the human calcitonin receptor (EC50 = 11 nM)
HADGVFTSDFSKLLGQLSAKKYLESLM-NH2    (SEQ ID NO: 943)

Calcitoninreceptor-stimulating peptide-1
(Endogenous central calcitonin (CT) receptor agonist that stimulates cAMP formation at a potency
350-fold greater than CT (ED50 values are 0.2 and 71 nM respectively). Displays no activity at
calcitonin-gene related peptide (CGRP) and adrenomedullin receptors. Inhibits formation of
multinuclear osteoclasts with similar efficacy to CT in vitro. Suppresses food intake and increases
body temperature in free-feeding rats, and significantly decreases plasma calcium levels in vivo.)
SCNTATCMTHRLVGLLSRSGSMVRSNLLPTKMGFKVFG-NH2    (SEQ ID NO: 944)

AC 187
(Orally active, potent amylin receptor antagonist (IC50 = 0.48 nM) that displays 38-fold and 400-fold
selectivity over calcitonin and CGRP receptors respectively. Blocks amyloid β-induced neurotoxicity
by attenuating the activation of initiator and effector caspases in vitro. Increases glucagon
secretion, accelerates gastric emptying, alters plasma glucose levels and increases food intake
in vivo.)
Ac-VLGKLSQQLHKLQTYPRTNTGSNTY-NH2    (SEQ ID NO: 945)

VIP (guinea pig)
(Neuropeptide with many biological actions; plays a role in neurotransmission, smooth muscle
relaxation and has trophic and mitogenic actions.)
HSDALFTDTYTRLRKQMAMKKYLNSVLN-NH2    (SEQ ID NO: 946)

{Ala2,8,9,11,19,22,24,25,27,28}-VIP
(Highly selective agonist for the VPAC1 receptor (IC50 values are ~11.5-13.2 and >30000 nM for
VPAC1 and VPAC2 receptors respectively)))
HADAVFTAAYARLRKQMAAKKALAAIAA-NH2    (SEQ ID NO: 947)

{Ac-Tyr1,D-Phe2}GRF 1-29, amide (human)
(VIP antagonist; inhibits {125I}iodo-VIP binding and selectively inhibits VIP- and GRF-induced
effects on adenylyl cyclase.)
Ac-YdFDAIFTNSYRKVLGQLSARKLLQDIMSR-NH2    (SEQ ID NO: 948)

VIP (6-28) (human, rat, porcine, bovine) (VIP antagonist.)
FTDNYTRLRKQMAVKKYLNSILN-NH2    (SEQ ID NO: 949)

{D-p-Cl-Phe6,Leu17}-VIP
(Selective vasoactive intestinal peptide (VIP) antagonist (IC50 = 125.8 nM). Displays no activity on
glucagon, secretin or GRF receptors.)
HSDAVFTDNYTRLRKQLAVKKYLNSILN-NH2 Phe-6 = p-Cl-D-Phe   (SEQ ID NO: 950)

Neurotensin
XLYENKPRRPYIL  X = Pyroglutamic acid (Pyr) (pGlu)    (SEQ ID NO: 951)

N-stearyl-{Nle17}neurotensin(6-11)/VIP(7-28)

neurotensin(6-11)/PACAP(6-38)

human pancreatic polypeptide
APLEPVYPGDNATPEQMAQYAADLRRYINMLTRPRY    (SEQ ID NO: 952)

Kinetensin (human) (Endogenous neurotensin-like peptide, originally isolated from pepsin-treated
human plasma. Induces histamine release from rat peritoneal mast cells in vitro (ED50 ~10 mM).)
IARRHPYFL    (SEQ ID NO: 953)

JMV 449
(Potent, metabolically stable neurotensin receptor agonist peptide (IC50 = 0.15 nM for inhibition of
{125I}-NT binding to neonatal mouse brain; EC50 = 1.9 nM for contraction of guinea pig ileum).
Produces long-lasting hypothermic, neuroprotective and analgesic effects in mice following central
administration in vivo.)
KKPYIL (Note: Lys-1-Lys-2 peptide bond replace with Psi(CH2—NH)))    (SEQ ID NO: 954)

TABLE 4-continued

Targets from which the Analogs are derived

Neuromedin N (rat, mouse, porcine, canine)
(Endogenous neurotensin-like neuropeptide, originally isolated from porcine spinal cord. Binds to
neurotensin receptors (IC50 = 16.7 nM for inhibition of {Trp11}-NT binding to rat brain receptors).
Regulates guinea pig intestinal smooth muscle contraction and produces hypotension in rats. Also
induces hypothermia following central administration in rats in vivo.)
KIPYIL (SEQ ID NO: 955)

des-His1-{Glu9}-Glucagon (1-29) amide
(Glucagon receptor antagonist (pA2 = 7.2 for inhibition of glucagon-induced adenylyl cyclase
activation in rat liver membranes); displays no agonist activity. Enhances glucose-stimulated
pancreatic insulin release in vitro. In vivo, blocks added glucagon-induced hyperglycemia in normal
rabbits without affecting glycogenolysis. Also blocks endogenous glucagon-induced hyperglycemia
in streptozocin diabetic rats.)
SQGTFTSEYSKYLDSRRAQDFVQWLMNT-NH2 (SEQ ID NO: 956)

Antisauvagine-30
(Potent, selective and competitive corticotropin-releasing factor CRF2 receptor antagonist (Kd values
are 1.4 and 153.6 nM for binding to mouse CRF2β and rat CRF1 receptors respectively). Inhibits
sauvagine-stimulated cAMP accumulation in HEK-mCRF2β cells (pA2 = 8.49). Prevents stress-
enhanced fear conditioning and MEK 1/2-dependent activation of ERK1/2 in mice in vivo.)
dFHLLRKMIEIEKQEKEKQQAANNRLLLDTI-NH2 (SEQ ID NO: 957)

>gi|76781480|ref|NP_001020537.2|vascular endothelial growth factor A isoform a {Homo sapiens}
MTDRQTDTAPSPSYHLLPGRRRTVDAAASRGQGPEPAPGGGVEGVGARGVALKLFVQLLGC
SRFGGAVVRAGEAEPSGAARSASSGREEPQPEEGEEEEKEEERGPQWRLGARKPGSWTGEA
AVCADSAPAARAPQALARASGRGGRVARRGAEESGPPHSPSRRGSASRAGPGRASETMNFL
LSWVHWSLALLLYLHHAKWSQAAPMAEGGGQNHHEVVKFMDVYQRSYCHPIETLVDIFQE
YPDEIEYIFKPSCVPLMRCGGCCNDEGLECVPTEESNITMQIMRIKPHQGQHIGEMSFLQHNK
CECRPKKDRARQEKKSVRGKGKGQKRKRKKSRYKSWSVYVGARCCLMPWSLPGPHPCGPC
SERRKHLFVQDPQTCKCSCKNTDSRCKARQLELNERTCRCDKPRR
(SEQ ID NO: 958)

>gi|76781481|ref|NP_003367.4|vascular endothelial growth factor A isoform b {Homo sapiens}
MTDRQTDTAPSPSYHLLPGRRRTVDAAASRGQGPEPAPGGGVEGVGARGVALKLEVQLLGC
SRFGGAVVRAGEAEPSGAARSASSGREEPQPEEGEEEEKEEERGPQWRLGARKPGSWTGEA
AVCADSAPAARAPQALARASGRGGRVARRGAEESGPPHSPSRRGSASRAGPGRASETMNFL
LSWVHWSLALLLYLHHAKWSQAAPMAEGGGQNHHEVVKFMDVYQRSYCHPIETLVDIFQE
YPDEIEYIFKPSCVPLMRCGGCCNDEGLECVPTEESNITMQIMRIKPHQGQHIGEMSFLQHNK
CECRPKKDRARQEKKSVRGKGKGQKRKRKKSRYKSWSVPCGPCSERRKHLFVQDPQTCKC
SCKNTDSRCKARQLELNERTCRCDKPRR
(SEQ ID NO: 959)

gi|76781482|ref|NP_001020538.2|vascular endothelial growth factor A isoform c {Homo sapiens}
MTDRQTDTAPSPSYHLLPGRRRTVDAAASRGQGPEPAPGGGVEGVGARGVALKLFVQLLGC
SRFGGAVVRAGEAEPSGAARSASSGREEPQPEEGEEEEKEEERGPQWRLGARKPGSWTGEA
AVCADSAPAARAPQALARASGRGGRVARRGAEESGPPHSPSRRGSASRAGPGRASETMNFL
LSWVHWSLALLLYLHHAKWSQAAPMAEGGGQNHHEVVKFMDVYQRSYCHPIETLVDIFQE
YPDEIEYIFKPSCVPLMRCGGCCNDEGLECVPTEESNITMQIMRIKPHQGQHIGEMSFLQHNK
CECRPKKDRARQEKKSVRGKGKGQKRKRKKSRPCGPCSERRKHLEVQDPQTCKCSCKNTDS
RCKARQLELNERTCRCDKPRR
(SEQ ID NO: 960)

>gi|76781483|ref|NP_001020539.2|vascular endothelial growth factor A isoform d {Homo sapiens}
MTDRQTDTAPSPSYHLLPGRRRTVDAAASRGQGPEPAPGGGVEGVGARGVALKLEVQLLGC
SRFGGAVVRAGEAEPSGAARSASSGREEPQPEEGEEEEKEEERGPQWRLGARKPGSWTGEA
AVCADSAPAARAPQALARASGRGGRVARRGAEESGPPHSPSRRGSASRAGPGRASETMNFL
LSWVHWSLALLLYLHHAKWSQAAPMAEGGGQNHHEVVKFMDVYQRSYCHPIETLVDIFQE
YPDEIEYIFKPSCVPLMRCGGCCNDEGLECVPTEESNITMQIMRIKPHQGQHIGEMSFLQHNK
CECRPKKDRARQENPCGPCSERRKHLFVQDPQTCKCSCKNTDSRCKARQLELNERTCRCDK
PRR >gi|76781487|ref|NP_001028928.1|vascular endothelial growth factor A isoform g {Homo sapiens}
MTDRQTDTAPSPSYHLLPGRRRTVDAAASRGQGPEPAPGGGVEGVGARGVALKLFVQLLGC
SRFGGAVVRAGEAEPSGAARSASSGREEPQPEEGEEEEKEEERGPQWRLGARKPGSWTGEA
AVCADSAPAARAPQALARASGRGGRVARRGAEESGPPHSPSRRGSASRAGPGRASETMNFL
LSWVHWSLALLLYLHHAKWSQAAPMAEGGGQNHHEVVKFMDVYQRSYCHPIETLVDIFQE
YPDEIEYIFKPSCVPLMRCGGCCNDEGLECVPTEESNITMQIMRIKPHQGQHIGEMSFLQHNK
CECRPKKDRARQENPCGPCSERRKHLFVQDPQTCKCSCKNTDSRCKARQLELNERTCRSLTR
KD
(SEQ ID NO: 961)

>gi|76781484|ref|NP_001020540.2|vascular endothelial growth factor A isoform e {Homo sapiens}
MTDRQTDTAPSPSYHLLPGRRRTVDAAASRGQGPEPAPGGGVEGVGARGVALKLFVQLLGC
SRFGGAVVRAGEAEPSGAARSASSGREEPQPEEGEEEEKEEERGPQWRLGARKPGSWTGEA
AVCADSAPAARAPQALARASGRGGRVARRGAEESGPPHSPSRRGSASRAGPGRASETMNFL TABLE 4-continued Targets from which the Analogs are derived

```
LSWVHWSLALLLYLHHAKWSQAAPMAEGGGQNHHEVVKFMDVYQRSYCHPIETLVDIFQE
YPDEIEYIFKPSCVPLMRCGGCCNDEGLECVPTEESNITMQIMRIKPHQGQHIGEMSFLQHNK
CECRPKKDRARQENPCGPCSERRKHLFVQDPQTCKCSCKNTDSRCKM
(SEQ ID NO: 962)

>gi|76781485|ref|NP_001020541.2|vascular endothelial growth factor A isoform f {Homo sapiens}
MTDRQTDTAPSPSYHLLPGRRRTVDAAASRGQGPEPAPGGGVEGVGARGVALKLFVQLLGC
SRFGGAVVRAGEAEPSGAARSASSGREEPQPEEGEEEEKEEERGPQWRLGARKPGSWTGEA
AVCADSAPAARAPQALARASGRGGRVARRGAEESGPPHSPSRRGSASRAGPGRASETMNFL
LSWVHWSLALLLYLHHAKWSQAAPMAEGGGQNHHEVVKFMDVYQRSYCHPIETLVDIFQE
YPDEIEYIFKPSCVPLMRCGGCCNDEGLECVPTEESNITMQIMRIKPHQGQHIGEMSFLQHNK
CECRPKKDRARQEKCDKPRR
(SEQ ID NO: 963)

>gi|4507887|ref|NP_003368.1|vascular endothelial growth factor B precursor {Homo sapiens}
MSPLLRRLLLAALLQLAPAQAPVSQPDAPGHQRKVVSWIDVYTRATCQPREVVVPLTVELM
GTVAKQLVPSCVTVQRCGGCCPDDGLECVPTGQHQVRMQILMIRYPSSQLGEMSLEEHSQC
ECRPKKKDSAVKPDRAATPHHRPQPRSVPGWDSAPGAPSPADITHPTPAPGPSAHAAPSTTSA
LTPGPAAAAADAAASSVAKGGA
(SEQ ID NO: 964)

>gi|4885653|ref|NP_005420.1|vascular endothelial growth factor C preproprotein {Homo sapiens}
MHLLGFFSVACSLLAAALLPGPREAPAAAAAFESGLDLSDAEPDAGEATAYASKDLEEQLRS
VSSVDELMTVLYPEYWKMYKCQLRKGGWQHNREQANLNSRTEETIKFAAAHYNTEILKSID
NEWRKTQCMPREVCIDVGKEFGVATNTFFKPPCVSVYRCGGCCNSEGLQCMNTSTSYLSKT
LFEITVPLSQGPKPVTISFANHTSCRCMSKLDVYRQVHSIIRRSLPATLPQCQAANKTCPTNYM
WNNHICRCLAQEDFMFSSDAGDDSTDGFHDICGPNKELDEETCQCVCRAGLRPASCGPHKEL
DRNSCQCVCKNKLFPSQCGANREFDENTCQCVCKRTCPRNQPLNPGKCACECTESPQKCLL
KGKKFHHQTCSCYRRPCTNRQKACEPGFSYSEEVCRCVPSYWKRPQMS
(SEQ ID NO: 965)
```

A-71623
(Potent CCK1 agonist (IC50 = 3.7 nM) with 1200-fold selectivity over the CCK2 receptor.
Suppresses food intake following central or peripheral administration.)
XWKDF-NH2  Trp-1 = Boc-Trp, Lys-3 = Lys(Tac), Phe-5 = N-methyl-Phe  (SEQ ID NO: 966)

Enterostatin
(N' terminal peptide fragment of procolipase that binds to the β-subunit of F1-ATPase. Activates the
ERK and cAMP signaling pathways, and downregulates expression of Kruppel-like factor 4 (KLF4)
and agouti-related peptide (AgRP) in vitro. Inhibits insulin secretion from pancreatic β-cells by
downregulating expression of dynamin2 and altering protein trafficking. Reduces dietary fat intake
via activation of CCK1, induces satiety, enhances memory-consolidation and exhibits
hypocholesterolemic activity in vivo. Orally active.))
APGPR  (SEQ ID NO: 967)

Ac2-12
(Annexin/lipocortin 1-mimetic peptide; inhibits leukocyte extravasation. Reduces neutrophil adhesion
and emigration, and promotes detachment of neutrophils from activated mesenteric endothelium in
mice in vivo.)
Ac-AMVSEFLKQA W Ac2-26
(Annexin/lipocortin 1-mimetic peptide; inhibits leukocyte extravasation. Reduces neutrophil adhesion
and emigration, and promotes detachment of neutrophils from activated mesenteric endothelium in
mice in vivo. Anti-inflammatory.)
Ac-AMVSEFLKQAWFIENEEQEYVQTVK  (SEQ ID NO: 968)

Peptide F9
(Peptide derived from the heparin-binding domain in the B1 chain of laminin. Binds to heparin,
promotes cell adhesion, and inhibits the migration towards, and adhesion of metastatic fibrosarcoma
cells to laminin.)
RYVVLPRPVCFEKGMNYTVR  (SEQ ID NO: 969)

R18
(Antagonist of 14.3.3 proteins (KD ≈80 nM). Competitively inhibits 14.3.3-ligand interactions
without requiring phosphorylation. Blocks the ability of 14.3.3 to bind to target proteins such as Raf-
1, Bad, ASK1 and exoenzyme S. Induces apoptosis.)
PHCVPRDLSWLDLEANMCLP  (SEQ ID NO: 970)

Thymosin β4
(Naturally occuring, potent regulator of actin polymerization present in human platelets at a
concentration of 200-500 μM. Sequesters G-actin monomers in a 1:1 ratio (Kd = 0.7-1.0 μM) and
allows rapid filament polymerization in the presence of profilin. Implicated in wound healing,
induction of MMPs, chemotaxis, angiogenesis, inflammatory processes and tumor progression.)
Ac-SDKPDMAEIEKFDKSKLKKTETQEKNPLPSKETIEQEKQAGES  (SEQ ID NO: 971)

TABLE 4-continued

Targets from which the Analogs are derived

Anti-GluR4 blocking peptide
(Synthetic peptide ({K}-HTGTAIRQSSGLAVIASDLP) corresponding to the C-terminal amino acids
883-902 of rat precursor GluR4 (Accession No. P19493) with a lysine added at the N-terminus of the
peptide. Immunogen used for anti-GluR4)
KHTGTAIRQSSGLAVIASDLP (SEQ ID NO: 972)

Anti-phospho-GluR1 (Ser831) phosphorylated blocking peptide
(Synthetic peptide (LIPQQ(pS)INEAI{K}) corresponding to amino acids 826-836 of rat mature
GluR1 (Accession No. P19490), with a phosphorylated serine at position 831, and a lysine added to
the C-terminus for conjugation. Immunogen used for anti-phospho-GluR1 (Ser831))
LIPQQSINEAI Ser-6 = phosphorylated Ser (SEQ ID NO: 973)

PHV (1-42)
HADGVFTSDFSKLLGQLSAKKYLESLMGKRVSSNISEDPVPV (SEQ ID NO: 974)

PRP
DVAHGILNQAYRKVLDQLSAGKHLQSLVA (SEQ ID NO: 975)

PHM
HADGVFTSDFSKLLGQLSAKKYLESLM

>gi|4501947|ref|NP_000665.1|adenosine receptor A1 {Homo sapiens}
MPPSISAFQAAYIGIEVLIALVSVPGNVLVIWAVKVNQALRDATFCFIVSLAVADVAVGALVI
PLAILINIGPQTYFHTCLMVACPVLILTQSSILALLAIAVDRYLRVKIPLRYKMVVTPRRAAVAI
AGCWILSFVVGLTPMFGWNNLSAVERAWAANGSMGEPVIKCEFEKVISMEYMVYFNFFVW
VLPPLLLMVLIYLEVFYLIRKQLNKKVSASSGDPQKYYGKELKIAKSLALILFLFALSWLPLHI
LNCITLFCPSCHKPSILTYIAIFLTHGNSAMNPIVYAFRIQKFRVTFLKIWNDHFRCQPAPPIDED
LPEERPDD
(SEQ ID NO: 976)

>gi|4501951|ref|NP_000667.1|adenosine receptor A2b {Homo sapiens}
MLLETQDALYVALELVIAALSVAGNVLVCAAVGTANTLQTPTNYFLVSLAAADVAVGLFAI
PFAITISLGFCTDFYGCLFLACFVLVLTQSSIFSLLAVAVDRYLAICVPLRYKSLVTGTRARGVI
AVLWVLAFGIGLTPFLGWNSKDSATNNCTEPWDGTTNESCCLVKCLFENVVPMSYMVYFNF
FGCVLPPLLIMLVIYIKIFLVACRQLQRTELMDHSRTTLQREIHAAKSLAMIVGIFALCWLPVH
AVNCVTLFQPAQGKNKPKWAMNMAILLSHANSVVNPIVYAYRNRDFRYTFHKIISRYLLCQ
ADVKSGNGQAGVQPALGVGL
(SEQ ID NO: 977)

>gi|4501953|ref|NP_000668.1|adenosine receptor A3 isoform 2 {Homo sapiens}
MPNNSTALSLANVTYITMEIFIGLCAIVGNVLVICVVKLNPSLQTTTFYFIVSLALADIAVGVL
VMPLAIVVSLGITIHFYSCLFMTCLLLIFTHASIMSLLAIAVDRYLRVKLTVRYKRVTTHRRIW
LALGLCWLVSFLVGLTPMFGWNMKLTSEYHRNVTFLSCQFVSVMRMDYMVYFSFLTWIFIP
LVVMCAIYLDIFYIIRNKLSLNLSNSKETGAFYGREFKTAKSLFLVLFLFALSWLPLSIINCIIYF
NGEVPQLVLYMGILLSHANSMMNPIVYAYKIKKFKETYLLILKACVVCHPSDSLDTSIEKNSE
(SEQ ID NO: 978)

>gi|4501957|ref|NP_000669.1|alpha-1D adrenergic receptor {Homo sapiens}
MTFRDLLSVSFEGPRPDSSAGGSSAGGGGSAGGAAPSEGPAVGGVPGGAGGGGVVGAGS
GEDNRSSAGEPGSAGAGGDVNGTAAVGGLVVSAQGVGVGVFLAAFILMAVAGNLLVILSV
ACNRHLQTVTNYFIVNLAVADLLLSATVLPFSATMEVLGFWAFGRAFCDVWAAVDVLCCT
ASILSLCTISVDRYVGVRHSLKYPAIMTERKAAAILALLWVVALVVSVGPLLGWKEPVPPDE
RFCGITEEAGYAVFSSVCSFYLPMAVIVVMYCRVYVVARSTTRSLEAGVKRERGKASEVVLR
IHCRGAATGADGAHGMRSAKGHTFRSSLSVRLLKFSREKKAAKTLAIVVGVFVLCWFPFFFV
LPLGSLFPQLKPSEGVFKVIFWLGYFNSCVNPLIYPCSSREFKRAFLRLLRCQCRRRRRRRPLW
RVYGHHWRASTSGLRQDCAPSSGDAPPGAPLALTALPDPDPEPPGTPEMQAPVASRRKPPSA
FREWRLLGPFRRPTTQLRAKVSSLSHKIRAGGAQRAEAACAQRSEVEAVSLGVPHEVAEGAT
CQAYELADYSNLRETDI
(SEQ ID NO: 979)

>gi|4501959|ref|NP_000670.1|alpha-1B adrenergic receptor {Homo sapiens}
MNPDLDTGHNTSAPAHWGELKNANFTGPNQTSSNSTLPQLDITRAISVGLVLGAFILFAIVGN
ILVILSVACNRHLRTPTNYFIVNLAMADLLLSFTVLPFSAALEVLGYWVLGRIFCDIWAAVDV
LCCTASILSLCAISIDRYIGVRYSLQYPTLVTRRKAILALLSVWVLSTVISIGPLLGWKEPAPND
DKECGVTEEPFYALFSSLGSFYIPLAVILVMYCRVYIVAKRTTKNLEAGVMKEMSNSKELTL
RIHSKNFHEDTLSSTKAKGHNPRSSIAVKLFKFSREKKAAKTLGIVVGMFILCWLPFFIALPLG
SLFSTLKPPDAVFKVVFWLGYFNSCLNPIIYPCSSKEFKRAFVRILGCQCRGRGRRRRRRRRL
GGCAYTYRPWTRGGSLERSQSRKDSLDDSGSCLSGSQRTLPSASPSPGYLGRGAPPPVELCAF
PEWKAPGALLSLPAPEPPGRRGRHDSGPLFTFKLLTEPESPGTDGGASNGGCEAAADVANGQ
PGFKSNMPLAPGQF
(SEQ ID NO: 980)

>gi|4501969|ref|NP_000015.1|adrenergic, beta-2-, receptor, surface {Homo sapiens}
MGQPGNGSAFLLAPNRSHAPDHDVTQQRDEVWVVGMGIVMSLIVLAIVFGNVLVITAIAKFE
RLQTVTNYFITSLACADLVMGLAVVPFGAAHILMKMWTFGNFWCEFWTSIDVLCVTASIETL
CVIAVDRYFAITSPFKYQSLLTKNKARVIILMVWIVSGLTSFLPIQMHWYRATHQEAINCYAN
ETCCDFFTNQAYAIASSIVSFYVPLVIMVFVYSRVFQEAKRQLQKIDKSEGRFHVQNLSQVEQ TABLE 4-continued Targets from which the Analogs are derived

```
DGRTGHGLRRSSKFCLKEHKALKTLGIIMGTFTLCWLPFFIVNIVHVIQDNLIREVYILLNWI
GYVNSGFNPLIYCRSPDFRIAFQELLCLRRSSLKAYGNGYSSNGNTGEQSGYHVEQEKENKLL
CEDLPGTEDFVGHQGTVPSDNIDSQGRNCSTNDSLL
(SEQ ID NO: 981)

>gi|4501997|ref|NP_000676.1|type-1 angiotensin II receptor {Homo sapiens}
MILNSSTEDGIKRIQDDCPKAGRHNYIFVMIPTLYSIIFVVGIFGNSLVVIVIYFYMKLKTVASV
FLLNLALADLCFLLTLPLWAVYTAMEYRWPFGNYLCKIASASVSFNLYASVFLLTCLSIDRYL
AIVHPMKSRLRRTMLVAKVTCIIIWLLAGLASLPAIIHRNVFFIENTNITVCAFHYESQNSTLPI
GLGLTKNILGFLFPFLIILTSYTLIWKALKKAYEIQKNKPRNDDIFKIIMAIVLFFFFSWIPHQIFT
FLDVLIQLGIIRDCRIADIVDTAMPITICIAYFNNCLNPLFYGFLGKKFKRYFLQLLKYIPPKAKS
HSNLSTKMSTLSYRPSDNVSSSTKKPAPCFEVE
(SEQ ID NO: 982)

>gi|4502331|ref|NP_000697.1|vasopressin V1a receptor {Homo sapiens}
MRLSAGPDAGPSGNSSPWWPLATGAGNTSREAEALGEGNGPPRDVRNEELAKLEIAVLAVT
FAVAVLGNSSVLLALHRTPRKTSRMHLFIRHLSLADLAVAFFQVLPQMCWDITYRFRGPDWL
CRVVKHLQVFGMFASAYMLVVMTADRYIAVCHPLKTLQQPARRSRLMIAAAWVLSFVLST
PQYFVFSMIEVNNVTKARDCWATFIQPWGSRAYVTWMTGGIFLAPCVSSVKSISRAKIRTVKMTFVIVTAYIVCWAPF
FIIQMWSVWDPMSVWTESENPTITITALLGSLNSCCNPWIYMFFSGHLLQDCVQSFPCCQNM
KEKFNKEDTDSMSRRQTFYSNNRSPTNSTGMWKDSPKSSKSIKFIPVST
(SEQ ID NO: 983)

>gi|4502333|ref|NP_000698.1|vasopressin V1b receptor {Homo sapiens}
MDSGPLWDANPTPRGTLSAPNATTPWLGRDEELAKVEIGVLATVLVLATGGNLAVLLTLGQ
LGRKRSRMHLFVLHLALTDLAVALFQVLPQLLWDITYRFQGPDLLCRAVKYLQVLSMFAST
YMLLAMTLDRYLAVCHPLRSLQQPGQSTYLLIAAPWLLAAIFSLPQVFIFSLREVIQGSGVLD
CWADFGFPWGPRAYLTWTTLAIFVLPVTMLTACYSLICHEICKNLKVKTQAWRVGGGGWR
TWDRPSPSTLAATTRGLPSRVSSINTISRAKIRTVKMTFVIVLAYIACWAPFFSVQMWSVWDK
NAPDEDSTNVAFTISMLLGNLNSCCNPWIYMGFNSHLLPRPLRHLACCGGPQPRMRRRLSDG
SLSSRHTTLLTRSSCPATLSLSLSLTLSGRPRPEESPRDLELADGEGTAETIIF
(SEQ ID NO: 984)

>gi|4502359|ref|NP_001695.1|brain-specific angiogenesis inhibitor 3 precursor {Homo sapiens}
MKAVRNLLIYIFSTYLLVMFGFNAAQDFWCSTLVKGVIYGSYSVSEMFPKNFTNCTWTLENP
DPTKYSIYLKFSKKDLSCSNFSLLAYQFDHFSHEKIKDLLRKNHSIMQLCNSKNAFVFLQYDK
NFIQIRRVFPTNFPGLQKKGEEDQKSFFEFLVLNKVSPSQFGCHVLCTWLESCLKSENGRTESC
GIMYTKCTCPQHLGEWGIDDQSLILLNNVVLPLNEQTEGCLTQELQTTQVCNLTREAKRPPK
EEFGMMGDHTIKSQRPRSVHEKRVPQEQADAAKFMAQTGESGVEEWSQWSTCSVTCGQGS
QVRTRTCVSPYGTHCSGPLRESRVCNNTALCPVHGVWEEWSPWSLCSFTCGRGQRTRTRSC
TPPQYGGRPCEGPETHHKPCNIALCPVDGQWQEWSSWSQCSVTCSNGTQQRSRQCTAAAHG
GSECRGPWAESRECYNPECTANGQWNQWGHWSGCSKSCDGGWERRIRTCQGAVITGQQCE
GTGEEVRRCSEQRCPAPYEICPEDYLMSMVWKRTPAGDLAFNQCPLNATGTTSRRCSLSLHG
VAFWEQPSFARCISNEYRHLQHSIKEHLAKGQRMLAGDGMSQVTKTLLDLTQRKNFYAGDL
LMSVEILRNVTDTFKRASYIPASDGVQNFFQIVSNLLDEENKEKWEDAQQIYPGSIELMQVIE
DFIHIVGMGMMDFQNSYLMTGNVVASIQKLPAASVLTDINFPMKGRKGMVDWARNSEDRV
VIPKSIFTPVSSKELDESSVFVLGAVLYKNLDLILPLTRNYTVINSKIIVVTIRPEPKTTDSFLEIE
LAHLANGTLNPYCVLWDDSKTNESLGTWSTQGCKTVLTDASHTKCLCDRLSTFAILAQQPR
EIIMESSGTPSVTLIVGSGLSCLALITLAVVYAALWRYIERSERSIILINFCLSIISSNILILVGQTQT
HNKSICTTTTAFLHFFFLASFCWVLTEAWQSYMAVTGKIRTRLIRKRFLCLGWGLPALVVAT
SVGFTRTKGYGTDHYCWLSLEGGLLYAFVGPAAAVVLVNMVIGILVPNKLVSRDGILDKKL
KHRAGQMSEPHSGLTLKCAKCGVVSTTALSATTASNAMASLWSSCVVLPLLALTWMSAVL
AMTDKRSILFQILFAVFDSLQGFVIVMVHCILRREVQDAFRCRLRNCQDPINADSSSSFPNGH
AQIMTDFEKDVDIACRSVLHKDIGPCRAATITGTLSRISLNDDEEEKGTNPEGLSYSTLPGNVI
SKVIIQQPTGLHMPMSMNELSNPCLKKENSELRRTVYLCTDDNLRGADMDIVHPQERMMES
DYIVMPRSSVNNQPSMKEESKMNIGMETLPHERLLHYKVNPEFNMNPPVMDQFNMNLEQH
LAPQEHMQNLPFEPRTAVKNFMASELDDNAGLSRSETGSTISMSSLERRKSRYSDLDFEKVM
HTRKRHMELFQELNQKFQTLDRFRDIPNTSSMENPAPNKNPWDTFKNPSEYPHYTTINVLDT
EAKDALELRPAEWEKCLNLPLDVQEGDFQTEV
(SEQ ID NO: 985)

>gi|4502415|ref|NP_001707.1|Burkitt lymphoma receptor 1 isoform 1 {Homo sapiens}
MNYPLTLEMDLENLEDLFWELDRLDNYNDTSLVENHLCPATEGPLMASFKAVFVPVAYSLIF
LLGVIGNVLVLVILERHRQTRSSTETFLFHLAVADLLLVFIPFAVAEGSVGWVLGTFLCKTVI
ALHKVNFYCSSLLLACIAVDRYLAIVHAVHAYRHRRLLSIHITCGTIWLVGFLLALPEILFAKV
SQGHHNNSLPRCTFSQENQAETHAWFTSRFLYHVAGFLLPMLVMGWCYVGVVHRLRQAQR
RPQRQKAVRVAILVTSIFFLCWSPYHIVIFLDTLARLKAVDNTCKLNGSLPVAITMCEFLGLA
HCCLNPMLYTFAGVKFRSDLSRLLTKLGCTGPASLCQLFPSWRRSSLSESENATSLTTF
(SEQ ID NO: 986)

>gi|4502455|ref|NP_001718.1|bombesin receptor subtype-3 {Homo sapiens}
MAQRQPHSPNQTLISITNDTESSSSVVSNDNTNKGWSGDNSPGIEALCAIYITYAVIISVGILGN
AILIKVFFKTKSMQTVPNIFITSLAFGDLLLLLTCVPVDATHYLAEGWLFGRIGCKVLSFIRLTS
VGVSVFTLTILSADRYKAVVKPLERQPSNAILKTCVKAGCWIVSMIFALPEAIFSNVYTFRD
PNKNMTFESCTSYPVSKKLLQEIHSLLCFLVFYIIPLSIISVYYSLIARTLYKSTLNIPTEEQSHAR
```

TABLE 4-continued

Targets from which the Analogs are derived

KQIESRKRIARTVLVLVALFALCWLPNHLLYLYHSFTSQTYVDPSAMHFIFTIFSRVLAFSNSC
VNPFALYWLSKSFQKHFKAQLFCCKAERPEPPVADTSLTTLAVMGTVPGTGSIQMSEISVTSF
TGCSVKQAEDRF
(SEQ ID NO: 987)

>gi|4502509|ref|NP_001727.1|C5a anaphylatoxin chemotactic receptor {Homo sapiens}
MNSFNYTTPDYGHYDDKDTLDLNTPVDKTSNTLRVPDILALVIFAVVFLVGVLGNALVVWV
TAFEAKRTINAIWFLNLAVADFLSCLALPILFTSIVQHHHWPFGGAACSILPSLILLNMYASILL
LATISADRFLLVFKPIWCQNFRGAGLAWIACAVAWGLALLLTIPSFLYRVVREEYFPPKVLCG
VDYSHDKRRERAVAIVRLVLGFLWPLLTLTICYTFILLRTWSRRATRSTKTLKVVVAVVASFF
IFWLPYQVTGIMMSFLEPSSPTFLLLNKLDSLCVSFAYINCCINPIIYVVAGQGFQGRLRKSLPS
LLRNVLTEESVVRESKSFTRSTVDTMAQKTQAV
(SEQ ID NO: 988)

>gi|4502547|ref|NP_001733.1|calcitonin receptor isoform 2 precursor {Homo sapiens}
MRFTFTSRCLALFLLLNHPTPILPAFSNQTYPTIEPKPFLYVVGRKKMMDAQYKCYDRMQQL
PAYQGEGPYCNRTWDGWLCWDDTPAGVLSYQFCPDYFPDFDPSEKVTKYCDEKGVWFKHP
ENNRTWSNYTMCNAFTPEKLKNAYVLYYLAIVGHSLSIFTLVISLGIFVFFRSLGCQRVTLHK
NMFLTYILNSMIIIHLVEVVPNGELVRRDPVSCKILHFFHQYMMACNYFWMLCEGIYLHTLI
VVAVFTEKQRLRWYYLLGWGFPLVPTTIHAITRAVYFNDNCWLSVETHLLYIIHGPVMAAL
VVNFFFLLNIVRVLVTKMRETHEAESHMYLKAVKATMILVPLLGIQFVVFPWRPSNKMLGKI
YDYVMHSLIHFQGFFVATIYCFCNNEVQTTVKRQWAQFKIQWNQRWGRRPSNRSARAAAA
AAEAGDIPIYICHQELRNEPANNQGEESAEIIPLNIIEQESSA
(SEQ ID NO: 989)

>gi|4502607|ref|NP_000721.1|cholecystokinin receptor type A {Homo sapiens}
MDVVDSLLVNGSNITPPCELGLENETLFCLDQPRPSKEWQPAVQILLYSLIFLLSVLGNTLVIT
VLIRNKRMRTVTNIFLLSLAVSDLMLCLFCMPFNLIPNLLKDFIFGSAVCKTTTYFMGTSVSVS
TFNLVAISLERYGAICKPLQSRVWQTKSHALKVIAATWCLSFTIMTPYPIYSNLVPPTKNNNQ
TANMCRFLLPNDVMQQSWHTFLLLILFLIPGIVMMVAYGLISLELYQGIKFEASQKKSAKERK
PSTTSSGKYEDSDGCYLQKTRPPRKLELRQLSTGSSSRANRIRSNSSAANLMAKKRVIRMLIVI
VVLFFLCWMPIFSANAWRAYDTASAERRLSGTPISFILLLSYTSSCVNPIIYCFMNKRFRLGFM
ATFPCCPNPGPPGARGEVGEEEEGGTTGASLSRFSYSHMSASVPPQ
(SEQ ID NO: 990)

>gi|4502631|ref|NP_001286.1|C-C chemokine receptor type 1 {Homo sapiens}
METPNTTEDYDTTTEFDYGDATPCQKVNERAFGAQLLPPLYSLVFVIGLVGNILVVLVQY
KRLKNMTSIYLLNLAISDLLFLTLPFWIDYKLKDDWVFGDAMCKILSGFYYTGLYSEIFFIIL
LTIDRYLAIVHAVFALRARTVTFGVITSIIIWALAILASMPGLYFSKTQWEFTHHTCSLHFPHES
LREWKLFQALKLNLFGLVLPLLVMIICYTGIIKILLRRPNEKKSKAVRLIFVIMIIFFLFWTPYN
LTILISVFQDFLFTHECEQSRHLDLAVQVTEVIAYTHCCVNPVIYAFVGERFRKYLRQLFHRR
VAVHLVKWLPFLSVDRLERVSSTSPSTGEHELSAGF
(SEQ ID NO: 991)

>gi|4502637|ref|NP_001828.1|C-C chemokine receptor type 3 isoform 1 {Homo sapiens}
MTTSLDTVETFGTTSYYDDVGLLCEKADTRALMAQFVPPLYSLVFTVGLLGNVVVVMILIKY
RRLRIMTNIYLLNLAISDLLFLVTLPFWIHYVRGHNWVFGHGMCKLLSGFYHTGLYSEIFFIIL
LTIDRYLAIVHAVFALRARTVTFGVITSIVTWGLAVLAALPEFIFYETEELFEETLCSALYPEDT
VYSWRHFHTLRMTIFCLVLPLLVMAICYTGIIKTLLRCPSKKKYKAIRLIFVIMAVFFIFWTPY
NVAILLSSYQSILFGNDCERSKHLDLVMLVTEVIAYSHCCMNPVIYAFVGERFRKYLRHFFHR
HLLMHLGRYIPFLPSEKLERTSSVSPSTAEPELSIVF
(SEQ ID NO: 992)

>gi|4502639|ref|NP_000570.1|chemokine (C-C motif) receptor 5 {Homo sapiens}
MDYQVSSPIYDINYYTSEPCQKINVKQIAARLLPPLYSLVFIFGFVGNMLVILILINCKRLKSMT
DIYLLNLAISDLFFLLTVPFWAHYAAAQWDFGNTMCQLLTGLYFIGFFSGIFFIILLTIDRYLAV
VHAVFALKARTVTFGVVTSVITWVVAVFASLPGIIFTRSQKEGLHYTCSSHFPYSQYQFWKN
FQTLKIVILGLVLPLLVMVICYSGILKTLLRCRNEKKRHRAVRLIFTIMIVYFLFWAPYNIVLLL
NTFQEFFGLNNCSSSNRLDQAMQVTETLGMTHCCINPIIYAFVGEKFRNYLLVFFQKHIAKRF
CKCCSIFQQEAPERASSVYTRSTGEQEISVGL
(SEQ ID NO: 993)

>gi|4502641|ref|NP_001829.1|chemokine (C-C motif) receptor 7 precursor {Homo sapiens}
MDLGKPMKSVLVVALLVIFQVCLCQDEVTDDYIGDNTTVDYTLFESLCSKKDVRNFKAWFL
PIMYSIICFVGLLGNGLVVLTYIYFKRLKTMTDTYLLNLAVADILFLLTLPFWAYSAAKSWVF
GVHFCKLIFAIYKMSFFSGMLLLLCISIDRYVAIVQAVSAHRHRARVLLISKLSCVGIWILATV
LSIPELLYSDLQRSSSEQAMRCSLITEHVEAFITIQVAQMVIGFLVPLLAMSFCYLVIIRTLLQA
RNFERNKAIKVIIAVVVFIVFQLPYNGVVLAQTVANFNITSSTCELSKQLNIAYDVTYSLACV
RCCVNPFLYAFIGVKFRNDLFKLFKDLGCLSQEQLRQWSSCRHIRRSSMSVEAETTTTFSP
(SEQ ID NO: 994)

>gi|4502817|ref|NP_000730.1|cholinergic receptor, muscarinic 2 {Homo sapiens}
MNNSTNSSNNSLALTSPYKTFEVVFIVLVAGSLSLVTIIGNILVMVSIKVNRHLQTVNNYFLFS
LACADLIIGVFSMNLYTLYTVIGYWPLGPVVCDLWLALDYVVSNASVMNLLIISFDRYFCVT
KPLTYPVKRTTKMAGMMIAAAWVLSFILWAPAILFWQFIVGVRTVEDGECYIQFFSNAAVTF
GTAIAAFYLPVIIMTVLYWHISRASKSRIKKDKKEPVANQDVSPSLVQGRIVKPNNNNMPSS
DDGLEHNKIQNGKAPRDPVTENCVQGEEKESSNDSTSVSAVASNMRDDEITQDENTVSTSLG
HSKDENSKQTCIRIGTKTPKSDSCTPTNTTVEVVGSSGQNGDEKQNIVARKIVKMTKQPAKK TABLE 4-continued Targets from which the Analogs are derived KPPPSREKKVTRTILAILLAFIITWAPYNVMVLINTFCAPCIPNTVWTIGYWLCYINSTINPACY
ALCNATFKKTFKHLLMCHYKNIGATR
(SEQ ID NO: 995)

>gi|4502819|ref|NP_000731.1|cholinergic receptor, muscarinic 3 {Homo sapiens}
MTLHNNSTTSPLFPNISSSWIHSPSDAGLPPGTVTHFGSYNVSRAAGNFSSPDGTTDDPLGGHT
VWQVVFIAFLTGILALVTIIGNILVIVSFKVNKQLKTVNNYFLLSLACADLIIGVISMNLFTTYII
MNRWALGNLACDLWLAIDYVASNASVMNLLVISFDRYFSITRPLTYRAKRTTKRAGVMIGL
AWVISFVLWAPAILFWQYFVGKRTVPPGECFIQFLSEPTITFGTAIAAFYMPVTIMTILYWRIY
KETEKRTKELAGLQASGTEAETENFVHPTGSSRSCSSYELQQQSMKRSNRRKYGRCHFWFTT
KSWKPSSEQMDQDHSSSDSWNNNDAAASLENSASSDEEDIGSETRAIYSIVLKLPGHSTILNS
TKLPSSDNLQVPEEELGMVDLERKADKLQAQKSVDDGGSFPKSFSKLPIQLESAVDTAKTSD
VNSSVGKSTATLPLSFKEATLAKRFALKTRSQITKRKRMSLVKEKKAAQTLSAILLAFIITWTP
YNIMVLVNTFCDSCIPKTFWNLGYWLCYINSTVNPVCYALCNKTFRTTFKMLLL
CQCDKKRRKQQYQQRQSVIFHKRAPEQAL
(SEQ ID NO: 996)

>gi|4502929|ref|NP_001832.1|cannabinoid receptor 2 {Homo sapiens}
MEECWVTEIANGSKDGLDSNPMKDYMILSGPQKTAVAVLCTLLGLLSALENVAVLYLILSSH
QLRRKPSYLFIGSLAGADFLASVVFACSFVNFHVFHGVDSKAVFLLKIGSVTMTFTASVGSLL
LTAIDRYLCLRYPPSYKALLTRGRALVTLGIMWVLSALVSYLPLMGWTCCPRPCSELFPLIPN
DYLLSWLLFIAFLFSGIIYTYGHVLWKAHQHVASLSGHQDRQVPGMARMRLDVRLAKTLGL
VLAVLLICWFPVLALMAHSLATTLSDQVKKAFAFCSMLCLINSMVNPVIYALRSGEIRSSAHH
CLAHWKKCVRGLGSEAKEEAPRSSVTETEADGKITPWPDSRDLDLSDC
(SEQ ID NO: 997)

>gi|4503171|ref|NP_001328.1|CX3C chemokine receptor 1 isoform b {Homo sapiens}
MDQFPESVTENFEYDDLAEACYIGDIVVFGTVFLSIFYSVIFAIGLVGNLLVVFALTNSKKPKS
VTDIYLLNLALSDLLFVATLPFWTHYLINEKGLHNAMCKFTTAFFFIGFFGSIFFITVISIDRYL
AIVLAANSMNNRTVQHGVTISLGVWAAAILVAAPQFMFTKQKENECLGDYPEVLQEIWPVL
RNVETNFLGFLLPLLIMSYCYFRIIQTLFSCKNHKKAKAIKLILLVVIVFFLFWTPYNVMIFLET
LKLYDFFPSCDMRKDLRLALSVTETVAFSHCCLNPLIYAFAGEKFRRYLYHLYGKCLAVLCG
RSVHVDFSSSESQRSRHGSVLSSNFTYHTSDGDALLLL
(SEQ ID NO: 998)

>gi|4503175|ref|NP_003458.1|chemokine (C-X-C motif) receptor 4 isoform b {Homo sapiens}
MEGISIYTSDNYTEEMGSGDYDSMKEPCFREENANFNKIFLPTIYSIIFLTGIVGNGLVILVMG
YQKKLRSMTDKYRLHLSVADLLFVITLPFWAVDAVANWYFGNFLCKAVHVIYTVNLYSSVL
ILAFISLDRYLAIVHATNSQRPRKLLAEKVVYVGVWIPALLLTIPDFIFANVSEADDRYICDRF
YPNDLWVVVFQFQHIMVGLILPGIVILSCYCIIISKLSHSKGHQKRKALKTTVILILAFFACWLP
YYIGISIDSFILLEIIKQGCEFENTVHKWISITEALAFFHCCLNPILYAFLGAKFKTSAQHALTSV
SRGSSLKILSKGKRGGHSSVSTESESSSFHSS
(SEQ ID NO: 999)

>gi|4503383|ref|NP_000785.1|d(1A) dopamine receptor {Homo sapiens}
MRTLNTSAMDGTGLVVERDFSVRILTACFLSLLILSTLLGNTLVCAAVIRFRHLRSKVTNFFVI
SLAVSDLLVAVLVMPWKAVAEIAGFWPFGSFCNIWVAFDIMCSTASILNLCVISVDRYWAISS
PFRYERKMTPKAAFILISVAWTLSVLISFIPVQLSWHKAKPTSPSDGNATSLAETIDNCDSSLSR
TYAISSSVISFYIPVAIMIVTYTRIYRIAQKQIRRIAALERAAVHAKNCQTTTGNGKPVECSQPE
SSFKMSFKRETKVLKTLSVIMGVFVCCWLPFFILNCILPFCGSGETQPFCIDSNTFDVFVWFGW
ANSSLNPIIYAFNADFRKAFSTLLGCYRLCPATNNAIETVSINNNGAAMFSSHHEPRGSISKEC
NLVYLIPHAVGSSEDLKKEEAAGIARPLEKLSPALSVILDYDTDVSLEKIQPITQNGQHPT
(SEQ ID NO: 1000)

>gi|4503385|ref|NP_000786.1|d(2) dopamine receptor isoform long {Homo sapiens}
MDPLNLSWYDDDLERQNWSRPFNGSDGKADRPHYNYYATLLTLLIAVIVFGNVLVCMAVS
REKALQTTTNYLIVSLAVADLLVATLVMPWVVYLEVVGEWKFSRIHCDIFVTLDVMMCTAS
ILNLCAISIDRYTAVAMPMLYNTRYSSKRRVTVMISIVWVLSFTISCPLLFGLNNADQNECIIA
NPAFVVYSSIVSFYVPFIVTLLVYIKIYIVLRRRRKRVNTKRSSRAFRAHLRAPLKGNCTHPED
MKLCTVIMKSNGSFPVNRRRVEAARRAQELEMEMLSSTSPPERTRYSPIPPSHHQLTLPDPSH
HGLHSTPDSPAKPEKNGHAKDHPKIAKIFEIQTMPNGKTRTSLKTMSRRKLSQQKEKKATQM
LAIVLGVFIICWLPFFITHILNIHCDCNIPPVLYSAFTWLGYVNSAVNPIIYTTFNIEFRKAFLKIL
HC
(SEQ ID NO: 1001)

>gi|4503391|ref|NP_000789.1|d(1B) dopamine receptor {Homo sapiens}
MLPPGSNGTAYPGQFALYQQLAQGNAVGGSAGAPPLGPSQVVTACLLTLLIIWTLLGNVLVC
AAIVRSRHLRANMTNVFIVSLAVSDLFVALLVMPWKAVAEVAGYWPFGAFCDVWVAFDIM
CSTASILNLCVISVDRYWAISRPFRYKRKMTQRMALVMVGLAWTLSILISFIPVQLNWHRDQ
AASWGGLDLPNNLANWTPWEEDFWEPDVNAENCDSSLNRTYAISSSLISFYIPVAIMIVTYTR
IYRIAQVQIRRISSLERAAEHAQSCRSSAACAPDTSLRASIKKETKVLKTLSVIMGVFVCCWLP
FFILNCMVPFCSGHPEGPPAGFPCVSETTFDVFVWFGWANSSLNPVIYAFNADFQKVFAQLLG
CSHFCSRTPVETVNISNELISYNQDIVFHKEIAAAYIHMMPNAVTPGNREVDNEEEGPFDRM
FQIYQTSPDGDPVAESVWELDCEGEISLDKITPFTPNGFH
(SEQ ID NO: 1002)

TABLE 4-continued

Targets from which the Analogs are derived

>gi|4503459|ref|NP_003766.1|sphingosine-1-phosphate receptor 4 precursor {Homo sapiens}
MNATGTPVAPESCQQLAAGGHSRLIVLHYNHSGRLAGRGGPEDGGLGALRGLSVAASCLVV
LENLLVLAAITSHMRSRRWVYYCLVNITLSDLLTGAAYLANVLLSGARTFRLAPAQWFLREG
LLFTALAASTFSLLFTAGERFATMVRPVAESGATKTSRVYGFIGLCWLLAALLGMLPLLGWN
CLCAFDRCSSLLPLYSKRYILFCLVIFAGVLATIMGLYGAIFRLVQASGQKAPRPAARRKARR
LLKTVLMILLAFLVCWGPLFGLLLADVFGSNLWAQEYLRGMDWILALAVLNSAVNPIIYSFR
SREVCRAVLSFLCCGCLRLGMRGPGDCLARAVEAHSGASTTDSSLRPRDSFRGSRSLSFRMR
EPLSSISSVRSI
(SEQ ID NO: 1003)

>gi|4503465|ref|NP_001948.1|endothelin-1 receptor isoform a precursor {Homo sapiens}
METLCLRASFWLALVGCVISDNPERYSTNLSNHVDDFTTFRGTELSFLVTTHQPTNLVLPSNG
SMHNYCPQQTKITSAFKYINTVISCTIFIVGMVGNATLLRIIYQNKCMRNGPNALIASLALGDL
IYVVIDLPINVFKLLAGRWPFDHNDFGVFLCKLFPFLQKSSVGITVLNLCALSVDRYRAVASW
SRVQGIGIPLVTAIEIVSIWILSFILAIPEAIGFVMVPFEYRGEQHKTCMLNATSKFMEFYQDVK
DWWLFGFYFCMPLVCTAIFYTLMTCEMLNRRNGSLRIALSEHLKQRREVAKTVFCLVVIFAL
CWFPLHLSRILKKTVYNEMDKNRCELLSFLLLMDYIGINLATMNSCINPIALYFVSKKFKNCF
QSCLCCCCYQSKSLMTSVPMNGTSIQWKNHDQNNHNTDRSSHKDSMN
(SEQ ID NO: 1004)

>gi|4503779|ref|NP_002020.1|fMet-Leu-Phe receptor {Homo sapiens}
METNSSLPTNISGGTPAVSAGYLFLDIITYLVFAVTFVLGVLGNGLVIWVAGFRMTHTVTTIS
YLNLAVADFCFTSTLPFFMVRKAMGGHWPFGWFLCKFVFTIVDINLFGSVFLIALIALDRCVC
VLHPVWTQNHRTVSLAKKVIIGPWVMALLLTLPVIIRVTTVPGKTGTVACTFNFSPWTNDPK
ERINVAVAMLTVRGIIRFIIGFSAPMSIVAVSYGLIATKIHKQGLIKSSRPLRVLSFVAAAFFLC
WSPYQVVALIATVRIRELLQGMYKEIGIAVDVTSALAFFNSCLNPMLYVFMGQDFRERLIHA
LPASLERALTEDSTQTSDTATNSTLPSAEVELQAK
(SEQ ID NO: 1005)

>gi|4503781|ref|NP_001453.1|N-formyl peptide receptor 2 {Homo sapiens}
METNFSTPLNEYEEVSYESAGYTVLRILPLVVLGVTFVLGVLGNGLVIWVAGFRMTRTVTTI
CYLNLALADFSFTATLPFLIVSMAMGEKWPFGWFLCKLIHIVVDINLFGSVFLIGFIALDRCIC
VLHPVWAQNHRTVSLAMKVIVGPWILALVLTLPVFLFLTTVTIPNGDTYCTFNFASWGGTPE
ERLKVAITMLTARGIIRFVIGFSLPMSIVAICYGLIAAKIHKKGMIKSSRPLRVLTAVVASFFIC
WFPFQLVALLGTVWLKEMLFYGKYKIIDILVNPTSSLAFFNSCLNPMLYVFVGQDFRERLIHS
LPTSLERALSEDSAPTNDTAANSASPPAETELQAM
(SEQ ID NO: 1006)

>gi|4503905|ref|NP_003848.1|galanin receptor type 2 {Homo sapiens}
MNVSGCPGAGNASQAGGGGGWHPEAVIVPLLFALIFLVGTVGNTLVLLRGGQAVSTTN
LFILNLGVADLCFILCCVPFQATIYTLDGWVFGSLLCKAVHFLIFLTMHASSFTLAAVSLDRYL
AIRYPLHSRELRTPRNALAAIGLIWGLSLLFSGPYLSYYRQSQLANLTVCHPAWSAPRRRAM
DICTFVFSYLLPVLVLGLTYARTLRYLWRAVDPVAAGSGARRAKRKVTRMILIVAALFCLCW
MPHHALILCVWFGQFPLTRATYALRILSHLVSYANSCVNPIVYALVSKHFRKGFRTICAGLLG
RAPGRASGRVCAAARGTHSGSVLERESSDDLLHMSEAAGALRPCPGASQPCILEPCPGPSWQG
PKAGDSILTVDVA
(SEQ ID NO: 1007)

>gi|4503907|ref|NP_003605.1|galanin receptor type 3 {Homo sapiens}
MADAQNISLDSPGSVGAVAVPVVFALIFLLGTVGNGLVLAVLLQPGPSAWQEPGSTTDLFIL
NLAVADLCFILCCVPFQATIYTLDAWLFGALVCKAVHLLIYLTMYASSFTLAAVSVDRYLAV
RHPLRSRALRTPRNARAAVGLVWLLAALFSAPYLSYYGTVRYGALELCVPAWEDARRRAL
DVATFAAGYLLPVAVVSLAYGRTLRFLWAAVGPAGAAAAEARRRATGRAGRAMLAVAAL
YALCWGPHHALILCFWYGRFAFSPATYACRLASHCLAYANSCLNPLVYALASRHFRARFRR
LWPCGRRRRHRARRALRRVRPASSGPPGCPGDARPSGRLLAGGGQGPEPREGPVHGGEAAR
GPE
(SEQ ID NO: 1008)

>gi|4503947|ref|NP_000151.1|glucagon receptor precursor {Homo sapiens}
MPPCQPQRPLLLLLLLLACQPQVPSAQVMDFLFEKWKLYGDQCHHNLSLLPPPTELVCNRTF
DKYSCWPDTPANTTANISCPWYLPWHHKVQHRFVFKRCGPDGQWVRGPRGQPWRDASQC
QMDGEEIEVQKEVAKMYSSFQVMYTVGYSLSLGALLLALAILGGLSKLHCTRNAIHANLFAS
FVLKASSVLVIDGLLRTRYSQKIGDDLSVSTWLSDGAVAGCRVAAVFMQYGIVANYCWLLV
EGLYLHNLLGLATLPERSFFSLYLGIGWGAPMLFVVPWAVVKCLFENVQCWTSNDNMGFW
WILRFPVFLAILINFFIFVRIVQLLVAKLRARQMHHTDYKFRLAKSTLTLIPLLGVHEVVFAFV
TDEHAQGTLRSAKLFFDLFLSSFQGLLVAVLYCFLNKEVQSELRRRWHRWRLGKVLWEERN
TSNHRASSSPGHGPPSKELQFGRGGGSQDSSAETPLAGGLPRLAESPF
(SEQ ID NO: 1009)

>gi|4503999|ref|NP_000155.1|gastric inhibitory polypeptide receptor precursor {Homo sapiens}
MTTSPILQLLLRLSLCGLLLQRAETGSKGQTAGELYQRWERYRRECQETLAAAEPPSGLACN
GSFDMYVCWDYAAPNATARASCPWYLPWHHHVAAGFVLRQCGSDGQWGLWRDHTQCEN
PEKNEAFLDQRLILERLQVMYTVGYSLSLATLLLALLILSLFRRLHCTRNYIHINLFTSFMLRA
AAILSRDRLLPRPGPYLGDQALALWNQALAACRTAQIVTQYCVGANYTWLLVEGVYLHSLL
VLVGGSEEGHFRYYLLLGWGAPALFVIPWVIVRYLYENTQCWERNEVKAIWWIIRTPILMTI
LINFLIFIRILGILLSKLRTRQMRCRDYRLRLARSTLTLVPLLGVHEVVFAPVTEEQARGALRF TABLE 4-continued Targets from which the Analogs are derived AKLGFEIFLSSFQGFLVSVLYCFINKEVQSEIRRGWHHCRLRRSLGEEQRQLPERAFRALPSGS
GPGEVPTSRGLSSGTLPGPGNEASRELESYC
(SEQ ID NO: 1010)

>gi|4504059|ref|NP_000397.1|gonadotropin-releasing hormone receptor isoform 1 {Homo sapiens}
MANSASPEQNQNHCSAINNSIPLMQGNLPTLTLSGKIRVTVTFFLFLLSATFNASFLLKLQKW
TQKKEKGKKLSRMKLLLKHLTLANLLETLIVMPLDGMWNITVQWYAGELLCKVLSYLKLFS
MYAPAFMMVVISLDRSLAITRPLALKSNSKVGQSMVGLAWILSSVFAGPQLYIFRMIHLADSS
GQTKVFSQCVTHCSFSQWWHQAFYNFFTFSCLFIIPLFIMLICNAKIIFTLTRVLHQDPHELQL
NQSKNNIPRARLKTLKMTVAFATSFTVCWTPYYVLGIWYWFDPEMLNRLSDPVNHFFFLFAF
LNPCFDPLIYGYFSL
(SEQ ID NO: 1011)

>gi|4504091|ref|NP_001496.1|G-protein coupled estrogen receptor 1 {Homo sapiens}
MDVTSQARGVGLEMYPGTAQPAAPNTTSPELNLSHPLLGTALANGTGELSEHQQYVIGLFLS
CLYTIFLFPIGFVGNILILVVNISFREKMTIPDLYFINLAVADLILVADSLIEVFNLHERYYDIAV
LCTFMSLFLQVNMYSSVFFLTWMSFDRYIALARAMRCSLFRTKHHARLSCGLIWMASVSAT
LVPFTAVHLQHTDEACFCFADVREVQWLEVTLGFIVPFAIIGLCYSLIVRVLVRAHRHRGLRP
RRQKALRMILAVVLVFFVCWLPENVFISVHLLQRTQPGAAPCKQSFRHAHPLTGHIVNLAAF
SNSCLNPLIYSFLGETFRDKLRLYIEQKTNLPALNRFCHAALKAVIPDSTEQSDVRFSSAV
(SEQ ID NO: 1012)

>gi|4504093|ref|NP_001497.1|G protein-coupled receptor 32 {Homo sapiens}
MNGVSEGTRGCSDRQPGVLTRDRSCSRKMNSSGCLSEEVGSLRPLTVVILSASIVVGVLGNG
LVLWMTVFRMARTVSTVCFFHLALADFMLSLSLPIAMYYIVSRQWLLGEWACKLYITFVFLS
YFASNCLLVFISVDRCISVLYPVWALNHRTVQRASWLAFGVWLLAAALCSAHLKFRTTRKW
NGCTHCYLAFNSDNETAQIWIEGVVEGHIIGTIGHFLLGFLGPLAIIGTCAHLIRAKLLREGWV
HANRPKRLLLVLVSAFFIFWSPFNVVLLVHLWRRVMLKEIYHPRMLLILQASFALGCVNSSL
NPFLYVFVGRDFQEKFFQSLTSALARAFGEEEFLSSCPRGNAPRE
(SEQ ID NO: 1013)

>gi|4504095|ref|NP_001498.1|motilin receptor {Homo sapiens}
MGSPWNGSDGPEGAREPPWPALPPCDERRCSPFPLGALVPVTAVCLCLFVVGVSGNVVTVM
LIGRYRDMRTTTNLYLGSMAVSDLLILLGLPFDLYRLWRSRPWVFGPLLCRLSLYVGEGCTY
ATLLHMTALSVERYLAICRPLRARVLVTRRRVRALIAVLWAVALLSAGPFLFLVGVEQDPGI
SVVPGLNGTARIASSPLASSPPLWLSRAPPPSPPSGPETAEAAALFSRECRPSPAQLGALRVML
WVTTAYFFLPFLCSILYGLIGRELWSSRRPLRGPAASGRERGHRQTVRVLLVVVLAFIICWL
PPHVGRIIYINTEDSRMMYFSQYFNIVALQLFYLSASINPILYNLISKKYRAAAFKLLLARKSRP
RGFHRSRDTAGEVAGDTGGDTVGYTETSANVKTMG
(SEQ ID NO: 1014)

>gi|4504097|ref|NP_001499.1|G-protein coupled receptor 39 {Homo sapiens}
MASPSLPGSDCSQIIDHSHVPEFEVATWIKITLILVYLIIFVMGLLGNSATIRVTQVLQKKGYLQ
KEVTDHMVSLACSDILVFLIGMPMEFYSIIWNPLTTSSYTLSCKLHTFLFEACSYATLLHVLTL
SFERYIAICHPFRYKAVSGPCQVKLLIGFVWVTSALVALPLLFAMGTEYPLVNVPSHRGLTCN
RSSTRHHEQPETSNMSICTNLSSRWTVFQSSIFGAFVVYLVVLLSVAFMCWNMMQVLMKSQ
KGSLAGGTRPPQLRKSESEESRTARRQTIIFLRLIVVTLAVCWMPNQIRRRIMAAAKPKHDWTR
SYFRAYMILLPFSETFFYLSSVINPLLYTVSSQQFRRVFVQVLCCRLSLQHANHEKRLRVHAH
STTDSARFVQRPLLFASRRQSSARRTEKIFLSTFQSEAEPQSKSQSLSLESLEPNSGAKPANSAA
ENGFQEHEV
(SEQ ID NO: 1015)

>gi|4504099|ref|NP_001495.1|C-X-C chemokine receptor type 3 isoform A {Homo sapiens}
MVLEVSDHQVLNDAEVAALLENFSSSYDYGENESDSCCTSPPCPQDFSLNFDRAFLPALYSLL
FLLGLLGNGAVAAVLLSRRTALSSTDTFLLHLAVADTLLVLTLPLWAVDAAVQWVFGSGLC
KVAGALFNINFYAGALLLACISFDRYLNIVHATQLYRRGPPARVTLTCLAVWGLCLLFALPD
FIFLSAHHDERLNATHCQYNFPQVGRTALRVLQLVAGFLLPLLVMAYCYAHILAVLLVSRGQ
RRLRAMRLVVVVVAFALCWTPYHLVVLVDILMDLGALARNCGRESRVDVAKSVTSGLGY
MHCCLNPLLYAFVGVKFRERMWMLLLRLGCPNQRGLQRQPSSSRRDSSWSETSEASYSGL
(SEQ ID NO: 1016)

>gi|4504141|ref|NP_000832.1|metabotropic glutamate receptor 4 precursor {Homo sapiens}
MPGKRGLGWWWARLPLCLLLSLYGPWMPSSLGKPKGHPHMNSIRIDGDITLGGLFPVHGRG
SEGKPCGELKKEKGIHRLEAMLFALDRINNDPDLLPNITLGARILDTCSRDTHALEQSLTFVQ
ALIEKDGTEVRCGSGGPPIITKPERVVGVIGASGSSVSIMVANILRLFKIPQISYASTAPDLSDNS
RYDFFSRVVPSDTYQAQAMVDIVRALKWNYVSTVASEGSYGESGVEAFIQKSREDGGVCIA
QSVKIPREPKAGEFDKIIRRLLETSNARAVIIFANEDDIRRVLEAARRANQTGHFFWMGSDSW
GSKIAPVLHLEEVAEGAVTILPKRMSVRGFDRYFSSRTLDNNRRNIWFAEFWEDNFHCKLSR
HALKKGSHVKKCTNRERIGQDSAYEQEGKVQFVIDAVYAMGHALHAMHRDLCPGRVGLCP
RMDPVDGTQLLKYIRNVNFSGIAGNPVTFNENGDAPGRYDIYQYQLRNDSAEYKVIGSWTD
HLHLRIERMHWPGSGQQLPRSICSLPCQPGERKKTVKGMPCCWHCEPCTGYQYQVDRYTCK
TCPYDMRPTENRTGCRPIPIIKLEWGSPWAVLPLFLAVVGIAATLFVVITFVRYNDTPIVKASG
RELSYVLLAGIFLCYATTFLMIAEPDLGTCSLRRIFLGLGMSVAALLTKTNRIYRIFEQGKRS
VSAPRFISPASQLAITFSLISLQLLGICVWFVVDPSHSVVDFQDQRTLDPRFARGVLKCDISDLS
LICLLGYSMLLMVTCTVYAIKTRGVPETFNEAKPIGFTMYTTCIVWLAFIPIFFGTSQSADKLY
IQTTTLTVSVSLSASVSLGMLYMPKVYIILFHPEQNVPKRKRSLKAVVTAATMSNKFTQKGN
FRPNGEAKSELCENLEAPALATKQTYVTYTNHAI
(SEQ ID NO: 1017)

TABLE 4-continued

Targets from which the Analogs are derived

>gi|4504143|ref|NP_000833.1|metabotropic glutamate receptor 5 isoform b precursor {Homo sapiens}
MVLLLILSVLLLKEDVRGSAQSSERRVVAHMPGDIIIGALFSVHHQPTVDKVHERKCGAVRE
QYGIQRVEAMLHTLERINSDPTLLPNITLGCEIRDSCWHSAVALEQSIEFIRDSLISSEEEGLV
RCVDGSSSSFRSKKPIVGVIGPGSSSVAIQVQNLLQLFNIPQIAYSATSMDLSDKTLFKYFMRV
VPSDAQQARAMVDIVKRYNWTYVSAVHTEGNYGESGMEAFKDMSAKEGICIAHSYKIYSN
AGEQSFDKLLKKLTSHLPKARVVACFCEGMTVRGLLMAMRRLGLAGEFLLLGSDGWADRY
DVTDGYQREAVGGITIKLQSPDVKWFDDYYLKLRPETNHRNPWFQEFWQHRFQCRLEGFPQ
ENSKYNKTCNSSLTLKTHHVQDSKMGFVINAIYSMAYGLHNMQMSLCPGYAGLCDAMKPI
DGRKLLESLMKTNFTGVSGDTILFDENGDSPGRYEIMNFKEMGKDYFDYINVGSWDNGELK
MDDDEVWSKKSNIIRSVCSEPCEKGQIKVIRKGEVSCCWTCPCKENEYVFDEYTCKACQLG
SWPTDDLTGCDLIPVQYLRWGDPEPIAAVVFACLGLLATLFVTVVFIIYRDTPVVKSSSRELC
YIILAGICLGYLCTFCLIAKPKQIYCYLQRIGIGLSPAMSYSALVTKTNRIARILAGSKKKICTK
KPRFMSACAQLVIAFILICIQLGIIVALFIMEPPDIMHDYPSIREVYLICNTTNLGVVTPLGYNGL
LILSCTFYAFKTRNVPANFNEAKYIAFTMYTTCIIWLAFVPIYFGSNYKIITMCFSVSLSATVAL
GCMFVPKVYIILAKPERNVRSAFTTSTVVRMHVGDGKSSSAASRSSSLVNLWKRRGSSGETL
SSNGKSVTWAQNEKSSRGQHLWQRLSIHINKKENPNQTAVIKPFPKSTESRGLGAGAGAGGS
AGGVGATGGAGCAGAGPGGPESPDAGPKALYDVAEAEEHFPAPARPRSPSPISTLSHRAGSA
SRTDDDVPSLHSEPVARSSSSQGSLMEQISSVVTRFTANISELNSMMLSTAAPSPGVGAPLCSS
YLIPKEIQLPTTMTTFAEIQPLPAIEVTGGAQPAAGAQAAGDAARESPAAGPEAAAAKPDLEE
LVALTPPSPFRDSVDSGSTTPNSPVSESALCIPSSPKYDTLIIRDYTQSSSSL
(SEQ ID NO: 1018)

>gi|4504147|ref|NP_000835.1|metabotropic glutamate receptor 7 isoform a precursor {Homo sapiens}
MVQLRKLLRVTLMKFPCCVLEVLLCALAAAARGQEMYAPHSIRIEGDVTLGGLFPVHAKG
PSGVPCGDIKRENGIHRLEAMLYALDQINSDPNLLPNVTLGARILDTCSRDTYALEQSLTFVQ
ALIQKDTSDVRCTNGEPPVFVKPEKVVGVIGASGSSVSIMVANILRLFQIPQISYASTAPELSD
DRRYDFFSRVVPPDSFQAQAMVDIVKALGWNYVSTLASEGSYGEKGVESFTQISKEAGGLCI
AQSVRIPQERKDRTIDFDRIIKQLLDTPNSRAVVIFANDEDIKQLLAAAKRADQVGHFLWVGS
DSWGSKINPLHQHEDIAEGAITIQPKRATVEGFDAYFTSRTLENNRRNVWFAEYWEENFNCK
LTISGSKKEDTDRKCTGQERIGKDSNYEQEGKVQFVIDAVYAMAHALHHMNKDLCADYRG
VCPEMEQAGGKKLLKYIRNVNFNGSAGTPVMFNKNGDAPGRYDIFQYQTTNTSNPGYRLIG
QWTDELQLNIEDMQWGKGVREIPASVCTLPCKPGQRKKTQKGTPCCWTCEPCDGYQYQFD
EMTCQHCPYDQRPNENRTGCQDIPIIKLEWHSPWAVIPVFLAMLGIIATIFVMATFIRYNDTPI
VRASGRELSYVLLTGIFLCYIITFLMIAKPDVAVCSFRRVFLGLGMCISYAALLTKTNRIYRIFE
QGKKSVTAPRLISPTSQLAITSSLISVQLLGVFIWFGVDPPNIIIDYDEHKTMNPEQARGVLKCD
ITDLQIICSLGYSILLMVTCTVYAIKTRGVPENFNEAKPIGFTMYTTCIVWLAFIPIFFGTAQSAE
KLYIQTTTLTISMNLSASVALGMLYMPKVYIIIFHPELNVQKRKRSFKAVVTAATMSSRLSHK
PSDRPNGEAKTELCENVDPNSPAAKKKYVSYNNLVI
(SEQ ID NO: 1019)

>gi|4504379|ref|NP_003658.1|leucine-rich repeat-containing G protein-coupled receptor 5 precursor {Homo sapiens}
MDTSRLGVLLSLPVLLQLATGGSSPRSGVLLRGCPTHCHCEPDGRMLLRVDCSDLGLSELPS
NLSVFTSYLDLSMNNISQLLPNPLPSLRFLEELRLAGNALTYIPKGAFTGLYSLKVLMLQNNQ
LRHVPTEALQNLRSLQSLRLDANHISYVPPSCFSGLHSLRHLWLDDNALTEIPVQAFRSLSAL
QAMTLALNKIHHIPDYAFGNLSSLVVLHLHNNRIHSLGKKCFDGLHSLETLDLNYNNLDEFP
TAIRTLSNLKELGFHSNNIRSIPEKAFVGNPSLITIHFYDNPIQFVGRSAFQHLPELRTLTLNGAS
QITEFPDLTGTANLESLTLTGAQISSLPQTVCNQLPNLQVLDLSYNLLEDLPSFSVCQKLQKID
LRHNEIYEIKVDTFQQLLSLRSLNLAWNKIAIIHPNAFSTLPSLHLDLSSNLLSSFPITGLHGLT
HLKLTGNHALQSLISSENFPELKVIEMPYAYQCCAFGVCENAYKISNQWNKGDNSSMDDLH
KKDAGMFQAQDERDLEDFLLDFEEDLKALHSVQCSPSPGPFKPCEHLLDGWLIRIGVWTIAV
LALTCNALVTSTVFRSPLYISPIKLLIGVIAAVNMLTGVSSAVLAGVDAFTGSFARHGAWWE
NGVGCHVIGFLSIFASESSVFLLTLAALERGFSVKYSAKFETKAPFSSLKVIILLCALLALTMA
AVPLLGGSKYGASPLCLPLPFGEPSTMGYMVALILLNSLCFLMMTIAYTKLYCNLDKGDLEN
IWDCSMVKHIALLLFTNCILNCPVAFLSFSSLINLTFISPEVIKFILLVVVPLPACLNPLLYILFNP
HFKEDLVSLRKQTYVWTRSKHPSLMSINSDDVEKQSCDSTQALVTFTSSSITYDLPPSSVPSPA
YPVTESCHLSSVAFVPCL
(SEQ ID NO: 1020)

>gi|4504491|ref|NP_000852.1|histamine H1 receptor {Homo sapiens}
MSLPNSSCLLEDKMCEGNKTTMASPQLMPLVVVLSTICLVTVGLNLLVLYAVRSERKLHTV
GNLYIVSLSVADLIVGAVVMPMNILYLLMSKWSLGRPLCLFWLSMDYVASTASIFSVFILCID
RYRSVQQPLRLKYRTKTRASATILGAWFLSFLWVIPILGWNHFMQQTSVRREDKCETDFYD
VTWFKVMTAIINFYLPTLLMLWFYAKIYKAVRQHCQHRELINRSLPSFSEIKLRPENPKGDAK
KPGKESPWEVLKRKPKDAGGGSVLKSPSQTPKEMKSPVVFSQEDDREVDKLYCFPLDIVHM
QAAAEGSSRDYVAVNRSHGQLKTDEQGLNTHGASEISEDQMLGDSQSFSRTDSDTTTETAPG
KGKLRSGSNTGLDYIKFTWKRLRSHSRQYVSGLHMNRERKAAKQLGFIMAAFILCWIPYFIFF
MVIAFCKNCCNEHLHMFTIWLGYINSTLNPLIYPLCNENFKKTFKRILHIRS
(SEQ ID NO: 1021)

>gi|4504533|ref|NP_000854.1|5-hydroxytryptamine receptor 1B {Homo sapiens}
MEEPGAQCAPPPPAGSETWVPQANLSSAPSQNCSAKDYIYQDSISLPWKVLLVMLLALITLAT
TLSNAFVIATVYRTRKLHTPANYLIASLAVTDLLVSILVMPISTMYTVTGRWTLGQVVCDFW
LSSDITCCTASILHLCVIALDRYWAITDAVEYSAKRTPKRAAVMIALVWVFSISISLPPFFWRQ
AKAEEEVSECVVNTDHILYTVYSTVGAFYFPTLLLIALYGRIYVEARSRILKQTPNRTGKRLT TABLE 4-continued Targets from which the Analogs are derived RAQLITDSPGSTSSVTSINSRVPDVPSESGSPVYVNQVKVRVSDALLEKKKLMAARERKATKT
LGIILGAFIVCWLPFFIISLVMPICKDACWFHLAIFDFFTWLGYLNSLINPIIYTMSNEDFKQAFH
KLIRFKCTS
(SEQ ID NO: 1022)

>gi|4504535|ref|NP_000855.1|5-hydroxytryptamine receptor 1D {Homo sapiens}
MSPLNQSAEGLPQEASNRSLNATETSEAWDPRTLQALKISLAVVLSVITLATVLSNAFVLTTIL
LTRKLHTPANYLIGSLATTDLLVSILVMPISIAYTITHTWNFGQILCDIWLSSDITCCTASILHLC
VIALDRYWAITDALEYSKRRTAGHAATMIAIVWAISICISIPPLFWRQAKAQEEMSDCLVNTS
QISYTIYSTCGAFYIPSVLLIILYGRIYRAARNRILNPPSLYGKRFTTAHLITGSAGSSLCSLNSSL
HEGHSHSAGSPLFFNHVKIKLADSALERKRISAARERKATKILGIILGAFIICWLPFFVVSLVLPI
CRDSCWIHPALFDFFTWLGYLNSLINPIIYTVFNEEFRQAFQKIVPFRKAS
(SEQ ID NO: 1023)

>gi|4504537|ref|NP_000856.1|5-hydroxytryptamine receptor 1E {Homo sapiens}
MNITNCTTEASMAIRPKTITEKMLICMTLVVITTLTTLLNLAVIMAIGTTKKLHQPANYLICSL
AVTDLLVAVLVMPLSIIYIVMDRWKLGYFLCEVWLSVDMTCCTCSILHLCVIALDRYWAITN
AIEYARKRTAKRAALMILTVWTISIFISMPPLFWRSHRRLSPPPSQCTIQHDHVIYTIYSTLGAF
YIPLTLILILYYRIYHAAKSLYQKRGSSRHLSNRSTDSQNSFASCKLTQTFCVSDFSTSDPTTEF
EKFHASIRIPPFDNDLDHPGERQQISSTRERKAARILGLILGAFILSWLPFFIKELIVGLSIYTVSS
EVADFLTWLGYVNSLINPLLYTSFNEDFKLAFKKLRCREHT
(SEQ ID NO: 1024)

>gi|4504541|ref|NP_000859.1|5-hydroxytryptamine receptor 2C {Homo sapiens}
MVNLRNAVHSFLVHLIGLLVWQCDISVSPVAAIVTDIFNTSDGGRFKFPDGVQNWPALSIVIII
IMTIGGNILVIMAVSMEKKLHNATNYFLMSLAIADMLVGLLVMPLSLLAILYDYVWPLPRYL
CPVWISLDVLFSTASIMHLCAISLDRYVAIRNPIEHSRFNSRTKAIMKIAIVWAISIGVSVPIPVI
GLRDEEKVFVNNTTCVLNDPNFVLIGSFVAFFIPLTIMVITYCLTIYVLRRQALMLLHGHTEEP
PGLSLDFLKCCKRNTAEEENSANPNQDQNARRRKKKERRPRGTMQAINNERKASKVLGIVFF
VFLIMWCPFFITNILSVLCEKSCNQKLMEKLLNVFVWIGYVCSGINPLVYTLFNKIYRRAFSN
YLRCNYKVEKKPPVRQIPRVAATALSGRELNVNIYRHTNEPVIEKASDNEPGIEMQVENLELP
VNPSSVVSERISSV
(SEQ ID NO: 1025)

>gi|4504545|ref|NP_000862.1|5-hydroxytryptamine receptor 6 {Homo sapiens}
MVPEPGPTANSTPAWGAGPPSAPGGSGWVAAALCVVIALTAAANSLLIALICTQPALRNTSN
FFLVSLFTSDLMVGLVVMPPAMLNALYGRWVLARGLCLLWTAFDVMCCSASILNLCLISLD
RYLLILSPLRYKLRMTPLRALALVLGAWSLAALASFLPLLLGWHELGHARPPVPGQCRLLAS
LPFVLVASGLTFFLPSGAICFTYCRILLAARKQAVQVASLTTGMASQASETLQVPRTPRPGVE
SADSRRLATKHSRKALKASLTLGILLGMFFVTWLPFFVANIVQAVCDCISPGLFDVLTWLG
CNSTMNPIIYPLFMRDFKRALGRFLPCPRCPRERQASLASPSLRTSHSGPRPGLSLQQVLPLPLP
PDSDSDSDAGSGGSSGLRLTAQLLLPGEATQDPPLPTRAAAAVNFFNIDPAEPELRPHPLGIPTN
(SEQ ID NO: 1026)

>gi|4504547|ref|NP_000863.1|5-hydroxytryptamine receptor 7 isoform a {Homo sapiens}
MMDVNSSGRPDLYGHLRSFLLPEVGRGLPDLSPDGGADPVAGSWAPHLLSEVTASPAPTWD
APPDNASGCGEQINYGRVEKVVIGSILTLITLLLTIAGNCLVVISVCFVKKLRQPSNYLIVSLALA
DLSVAVAVMPFVSVTDLIGGKWIFGHFFCNVFIAMDVMCCTASIMTLCVISIDRYLGITRPLT
YPVRQNGKCMAKMILSVWLLSASITLPPLFGWAQNVNDDKVCLISQDFGYTIYSTAVAFYIP
MSVMLFMYYQIYKAARKSAAKHKFPGFPRVEPDSVIALNGIVKLQKEVEECANLSRLLKHER
KNISIFKREQKAATTLGIIVGAFTVCWLPFFLLSTARPFICGTSCSCIPLWVERTFLWLGYANSL
INPFIYAFFNRDLRTTYRSLLQCQYRNINRKLSAAGMHEALKLAERPERPEFVLQNADYCRK
KGHDS
(SEQ ID NO: 1027)

>gi|4504681|ref|NP_000625.1|C—X—C chemokine receptor type 1 {Homo sapiens}
MSNITDPQMWDFDDLNFTGMPPADEDYSPCMLETETLNKYVVIIAYALVFLLSLLGNSLVML
VILYSRVGRSVTDVYLLNLALADLLFALTLPIWAASKVNGWIFGTFLCKVVSLLKEVNFYSGI
LLLACISVDRYLAIVHATRTLTQKRHLVKFVCLGCWGLSMNLSLPFFLFRQAYHPNNSSPVC
YEVLGNDTAKWRMVLRILPHTFGFIVPLFVMLFCYGFTLRTLFKAHMGQKHRAMRVIFAVV
LIFLLCWLPYNLVLLADTLMRTQVIQESCERRNNIGRALDATEILGFLHSCLNPIIYAFIGQNFR
HGFLKILAMHGLVSKEFLARHRVTSYTSSSVNVSSNL
(SEQ ID NO: 1028)

>gi|4504683|ref|NP_001548.1|C—X—C chemokine receptor type 2 {Homo sapiens}
MEDFNMESDSFEDFWKGEDLSNYSYSSTLPPFLLDAAPCEPESLEINKYFVVIIYALVFLLSLL
GNSLVMLVILYSRVGRSVTDVYLLNLALADLLFALTLPIWAASKVNGWIFGTFLCKVVSLLK
EVNFYSGILLLACISVDRYLAIVHATRTLTQKRYLVKFICLSIWGLSLLLALPVLLFRRTVYSS
NVSPACYEDMGNNTANWRMLLRILPQSFGFIVPLLIMLFCYGFTLRTLFKAHMGQKHRAMR
VIFAVVLIFLLCWLPYNLVLLADTLMRTQVIQETCERRNHIDRALDATEILGILHSCLNPLIYA
FIGQKFRHGLLKILAIHGLISKDSLPKDSRPSFVGSSSGHTSTTL
(SEQ ID NO: 1029)

>gi|4505127|ref|NP_000520.1|adrenocorticotropic hormone receptor {Homo sapiens}
MKHIINSYENINNTARNNSDCPRVVLPEEIFFTISIVGVLENLIVLLAVFKNKNLQAPMYFFICS
LAISDMLGSLYKILENILIILRNMGYLKPRGSFETTADDIIDSLFVLSLLGSIFSLSVIAADRYITIF TABLE 4-continued Targets from which the Analogs are derived

```
HALRYHSIVTMRRTVVVLTVIWTFCTGTGITMVIFSHHVPTVITFTSLFPLMLVFILCLYVHMF
LLARSHTRKISTLPRANMKGAITLTILLGVFIFCWAPFVLHVLLMTFCPSNPYCACYMSLFQV
NGMLIMCNAVIDPFIYAFRSPELRDAFKKMIFCSRYW
(SEQ ID NO: 1030)

>gi|4505445|ref|NP_000900.1|neuropeptide Y receptor type 1 {Homo sapiens}
MNSTLFSQVENHSVHSNFSEKNAQLLAFENDDCHLPLAMIFTLALAYGAVIILGVSGNLALIII
ILKQKEMRNVTNILIVNLSFSDLLVAIMCLPFTFVYTLMDHWVFGEAMCKLNPFVQCVSITVS
IFSLVLIAVERHQLIINPRGWRPNNRHAYVGIAVIWVLAVASSLPFLIYQVMTDEPFQNVTLD
AYKDKYVCFDQFPSDSHRLSYTTLLLVLQYFGPLCFIFICYFKIYIRLKRRNNMMDKMRDNK
YRSSETKRINIMLLSIVVAFAVCWLPLTIFNTVFDWNHQIIATCNHNLLFLLCHLTAMISTCVN
PIFYGFLNKNFQRDLQFFFNFCDFRSRDDDYETIAMSTMHTDVSKTSLKQASPVAFKKINNND
DNEKI
(SEQ ID NO: 1031)

>gi|4505447|ref|NP_000901.1|neuropeptide Y receptor Y2 {Homo sapiens}
MGPIGAEADENQTVEEMKVEQYGPQTTPRGELVPDPEPELIDSTKLIEVQVVLILAYCSIILLG
VIGNSLVIHVVIKFKSMRTVTNFFIANLAVADLLVNTLCLPFTLTYTLMGEWKMGPVLCHLV
PYAQGLAVQVSTITLTVIALDRHRCIVYHLESKISKRISFLIIGLAWGISALLASPLAIFREYSLIE
IIPDFEIVACTEKWPGEEKSIYGTVYSLSSLLILYVLPLGIISFSYTRIWSKLKNHVSPGAANDH
YHQRRQKTTKMLVCVVVVFAVSWLPLHAFQLAVDIDSQVLDLKEYKLIFTVPHIIAMCSTFA
NPLLYGWMNSNYRKAFLSAFRCEQRLDAIHSEVSVTFKAKKNLEVRKNSGPNDSFTEATNV
(SEQ ID NO: 1032)

>gi|4505513|ref|NP_000904.1|opiate receptor-like 1 {Homo sapiens}
MEPLFPAPFWEVIYGSHLQGNLSLLSPNHSLLPPHLLLNASHGAFLPLGLKVTIVGLYLAVCV
GGLLGNCLVMYVILRHTKMKTATNIYIFNLALADTLVLLTLPFQGTDILLGFWPFGNALCKT
VIAIDYYNMFTSTFTLTAMSVDRYVAICHPIRALDVRTSSKAQAVNVAIWALASVVGVPVAI
MGSAQVEDEEIECLVEIPTPQDYWGPVFAICIFLFSFIVPVLVISVCYSLMIRRLRGVRLLSGSR
EKDRNLRRITRLVLVVVAVFVGCWTPVQVFVLAQGLGVQPSSETAVAILRFCTALGYVNSCL
NPILYAFLDENFKACFRKFCCASALRRDVQVSDRVRSIAKDVALACKTSETVPRPA
(SEQ ID NO: 1033)

>gi|4505557|ref|NP_002554.1|P2Y purinoceptor 1 {Homo sapiens}
MTEVLWPAVPNGTDAAFLAGPGSSWGNSTVASTAAVSSSFKCALTKTGFQFYYLPAVYILVF
IIGFLGNSVAIWMFVFHMKPWSGISVYMFNLALADFLYVLTLPALIFYYFNKTDWIFGDAMC
KLQRFIFHVNLYGSILFLTCISAHRYSGVVYPLKSLGRLKKKNAICISVLVWLIVVVAISPILFY
SGTGVRKNKTITCYDTTSDEYLRSYFIYSMCTTVAMFCVPLVLILGCYGLIVRALIYKDLDNS
PLRRKSIYLVIIVLTVFAVSYIPFHVMKTMNLRARLDFQTPAMCAFNDRVYATYQVTRGLAS
LNSCVDPILYFLAGDTFRRRLSRATRKASRRSEANLQSKSEDMTLNILPEFKQNGDTSL
(SEQ ID NO: 1034)

>gi|4505561|ref|NP_002556.1|pyrimidinergic receptor P2Y4 {Homo sapiens}
MASTESSLLRSLGLSPGPGSSEVELDCWFDEDFKFILLPVSYAVVFVLGLGLNAPTLWLFIFRL
RPWDATATYMFHLALSDTLYVLSLPTLIYYYAAHNHWPFGTEICKFVRFLFYWNLYCSVLFL
TCISVHRYLGICHPLRALRWGRPRLAGLLCLAVWLVVAGCLVPNLFFVTTSNKGTTVLCHDT
TRPEEFDHYVHFSSAVMGLLFGVPCLVTLVCYGLMARRLYQPLPGSAQSSSRLRSLRTIAVV
LTVFAVCFVPFHITRTIYYLARLLEADCRVLNIVNVVYKVTRPLASANSCLDPVLYLLTGDKY
RRQLRQLCGGGKPQPRTAASSLALVSLPEDSSCRWAATPQDSSCSTPRADRL
(SEQ ID NO: 1035)

>gi|4506241|ref|NP_000943.1|platelet-activating factor receptor {Homo sapiens}
MEPHDSSHMDSEFRYTLFPIVYSIIFVLGVIANGYVLWVFARLYPCKKFNEIKIFMVNLTMAD
MLFLITLPLWIVYYQNQGNWILPKFLCNVAGCLFFINTYCSVAFLGVITYNRFQAVTRPIKTA
QANTRKRGISLSLVIWVAIVGAASYFLILDSTNTVPDSAGSGNVTRCFEHYEKGSVPVLIIHIFI
VFSFFLVFLIILFCNLVIIRTLLMQPVQQQRNAEVKRRALWMVCTVLAVFIICFVPHHVVQLP
WTLAELGFQDSKFHQAINDAHQVTLCLLSTNCVLDPVIYCFLTKKFRKHLTEKFYSMRSSRK
CSRATTDTVTEVVVPFNQIPGNSLKN
(SEQ ID NO: 1036)

>gi|4506259|ref|NP_000949.1|prostaglandin E2 receptor EP4 subtype {Homo sapiens}
MSTPGVNSSASLSPDRLNSPVTIPAVMFIFGVVGNLVAIVVLCKSRKEQKETTFYTLVCGLAV
TDLLGTLLVSPVTIATYMKGQWPGGQPLCEYSTFILLFFSLSGLSIICAMSVERYLAINHAYFY
SHYVDKRLAGLTLFAVYASNVLFCALPNMGLGSSRLQYPDTWCFIDWTTNVTAHAAYSYM
YAGFSSFLILATVLCNVLVCGALLRMHRQFMRRTSLGTEQHHAAAAASVASRGHPAASPAL
PRLSDFRRRRSFRRIAGAEIQMVILLIATSLVVLICSIPLVVRVFVNQLYQPSLEREVSKNPDLQ
AIRIASVNPILDPWIYILLRKTVLSKAIEKIKCLFCRIGGSRRERSGQHCSDSQRTSSAMSGHSR
SFISRELKEISSTSQTLLPDLSLPDLSENGLGGRNLLPGVPGMGLAQEDTTSLRTLRISETSDSS
QGQDSESVLLVDEAGGSGRAGPAPKGSSLQVTFPSETLNLSEKCI
(SEQ ID NO: 1037)

>gi|4506261|ref|NP_000950.1|prostaglandin F2-alpha receptor isoform a precursor {Homo sapiens}
MSMNNSKQLVSPAAALLSNTTCQTENRLSVFFSVIFMTVGILSNSLAIAILMKAYQRFRQKSK
ASFLLLASGLVITDFFGHLINGAIAVFVYASDKEWIRFDQSNVLCSIFGICMVFSGLCPLLLGSV
MAIERCIGVTKPIFHSTKITSKHVKMMLSGVCLFAVFIALLPILGHRDYKIQASRTWCFYNTED
IKDWEDRFYLLLFSFLGLLALGVSLLCNAITGITLLRVKFKSQQHRQGRSHHLEMVIQLLAIM
```

TABLE 4-continued

Targets from which the Analogs are derived

CVSCICWSPFLVTMANIGINGNHSLETCETTLFALRMATWNQILDPWVYILLRKAVLKNLYK
LASQCCGVHVISLHIWELSSIKNSLKVAAISESPVAEKSAST
(SEQ ID NO: 1038)

>gi|4506263|ref|NP_000951.1|prostaglandin I2 (prostacyclin) receptor (IP) {Homo sapiens}
MADSCRNLTYVRGSVGPATSTLMFVAGVVGNGLALGILSARRPARPSAFAVLVTGLAATDL
LGTSFLSPAVFVAYARNSSLLGLARGGPALCDAFAFAMTFFGLASMLILFAMAVERCLALSH
PYLYAQLDGPRCARLALPAIYAFCVLFCALPLLGLGQHQQYCPGSWCFLRMRWAQPGGAAF
SLAYAGLVALLVAAIFLCNGSVTLSLCRMYRQQKRHQGSLGPRPRTGEDEVDHLILLALMTV
VMAVCSLPLTIRCFTQAVAPDSSSEMGDLLAFRFYAFNPILDPWVFILFRKAVFQRLKLWVCC
LCLGPAHGDSQTPLSQLASGRRDPRAPSAPVGKEGSCVPLSAWGEGQVEPLPPTQQSSGSAV
GTSSKAEASVACSLC
(SEQ ID NO: 1039)

>gi|4506271|ref|NP_000307.1|parathyroid hormone receptor 1 precursor {Homo sapiens}
MGTARIAPGLALLLCCPVLSSAYALVDADDVMTKEEQIFLLHRAQAQCEKRLKEVLQRPASI
MESDKGWTSASTSGKPRKDKASGKLYPESEEDKEAPTGSRYRGRPCLPEWDHILCWPLGAP
GEVVAVPCPDYIYDFNHKGHAYRRCDRNGSWELVPGHNRTWANYSECVKFLTNETREREV
FDRLGMIYTVGYSVSLASLTVAVLILAYFRRLHCTRNYIHMHLFLSFMLRAVSIFVKDAVLYS
GATLDEAERLTEEELRAIAQAPPPPATAAAGYAGCRVAVTFFLYFLATNYYWILVEGLYLHS
LIFMAFFSEKKYLWGFTVFGWGLPAVFVAVWVSVRATLANTGCWDLSSGNKKWIIQVPILA
SIVLNFILFINIVRVLATKLRETNAGRCDTRQQYRKLLKSTLVLMPLFGVHYIVFMATPYTEVS
GTLWQVQMHYEMLFNSPQGFFVAIIYCFCNGEVQAEIKKSWSRWTLALDFKRKARSGSSSY
SYGPMVSHTSVTNVGPRVGLGLPLSPRLLPTATTNGHPQLPGHAKPGTPALETLETTPPAMA
APKDDGFLNGSCSGLDEEASGPERPPALLQEEWETVM
(SEQ ID NO: 1040)

>gi|4506403|ref|NP_003970.1|retinoic acid-induced protein 3 {Homo sapiens}
MATTVPDGCRNGLKSKYYRLCDKAEAWGIVLETVATAGVVTSVAFMLTLPILVCKVQDSNR
RKMLPTQFLFLLGVLGIFGLTFAFIIGLDGSTGPTRFFLFGILFSICFSCLLAHAVSLTKLVRGRK
PLSLLVILGLAVGFSLVQDVIAIEYIVLTMNRTNVNVFSELSAPRRNEDFVLLLTYVLFLMALT
FLMSSFTFCGSFTGWKRHGAHIYLTMLLSIAIWVAWITLLMLPDFDRRWDDTILSSALAANG
WVFLLAYVSPEFWLLTKQRNPMDYPVEDAFCKPQLVKKSYGVENRAYSQEEITQGFEETGD
TLYAPYSTHFQLQNQPPQKEFSIPRAHAWPSPYKDYEVKKEGS
(SEQ ID NO: 1041)

>gi|4507343|ref|NP_001049.1|substance-P receptor isoform long {Homo sapiens}
MDNVLPVDSDLSPNISTNTSEPNQFVQPAWQIVLWAAAYTVIVVTSVVGNVVVMWIILAHK
RMRTVTNYFLVNLAFAEASMAAFNTVVNFTYAVHNEWYYGLFYCKFHNFFPIAAVFASIYS
MTAVAFDRYMAIIHPLQPRLSATATKVVICVIWVLALLLAFPQGYYSTTETMPSRVVCMIEW
PEHPNKIYEKVYHICVTVLIYFLPLLVIGYAYTVVGITLWASEIPGDSSDRYHEQVSAKRKVV
KMMIVVVCTFAICWLPFHIFFLLPYINPDLYLKKFIQQVYLAIMWLAMSSTMYNPIIYCCLND
RFRLGFKHAFRCCPFISAGDYEGLEMKSTRYLQTQGSVYKVSRLETTISTVVGAHEEEPEDGP
KATPSSLDLTSNCSSRSDSKTMTESFSFSSNVLS
(SEQ ID NO: 1042)

>gi|4507381|ref|NP_001051.1|thromboxane A2 receptor isoform alpha {Homo sapiens}
MWPNGSSLGPCFRPTNITLEERRLIASPWFAASFCVVGLASNLLALSVLAGARQGGSHTRSSF
LTFLCGLVLTDFLGLLVTGTIVVSQHAALFEWHAVDPGCRLCRFMGVVMIFFGLSPLLLGAA
MASERYLGITRPFSRPAVASQRRAWATVGLVWAAALALGLLPLLGVGRYTVQYPGSWCFLT
LGAESGDVAFGLLFSMLGGLSVGLSFLLNTVSVATLCHVYHGQEAAQQRPRDSEVEMMAQL
LGIMVVASVCWLPLLVFIAQTVLRNPPAMSPAGQLSRTTEKELLIYLRVATWNQILDPWVYIL
FRRAVLRRLQPRLSTRPRSLSLQPQLTQRSGLQ
(SEQ ID NO: 1043)

>gi|4507681|ref|NP_003292.1|thyrotropin-releasing hormone receptor {Homo sapiens}
MENETVSELNQTQLQPRAVVALEYQVVTILLVLIICGLGIVGNIMVVLVVMRTKHMRTPTNC
YLVSLAVADLMVLVAAGLPNITDSIYGSWVYGYVGCLCITYLQYLGINASSCSITAFTIERYIA
ICHPIKAQFLCTFSRAKKIIIFVWAFTSLYCMLWFFLLDLNISTYKDAIVISCGYKISRNYYSPIY
LMDFGVFYVVPMILATVLYGFIARILFLNPIPSDPKENSKTWKNDSTHQNTNLNVNTSNRCFN
STVSSRKQVTKMLAVVVILFALLWMPYRTLVVVNSFLSSPFQENWFLLFCRICIYLNSAINPVI
YNLMSQKFRAAFRKLCNCKQKPTEKPANYSVALNYSVIKESDHFSTELDDITVTDTYLSATK
VSFDDTCLASEVSFSQS
(SEQ ID NO: 1044)

>gi|4557265|ref|NP_000675.1|beta-1 adrenergic receptor {Homo sapiens}
MGAGVLVLGASEPGNLSSAAPLPDGAATAARLLVPASPPASLLPPASESPEPLSQQWTAGMG
LLMALIVLLIVAGNVLVIVAIAKTPRLQTLTNLFIMSLASADLVMGLLVVPFGATIVVWGRW
EYGSFFCELWTSVDVLCVTASIETLCVIALDRYLAITSPFRYQSLLTRARARGLVCTVWAISAL
VSFLPILMHWWRAESDEARRCYNDPKCCDFVTNRAYAIASSVVSFYVPLCIMAFVYLRVFRE
AQKQVKKIDSCERRFLGGPARPPSPSPSPVPAPAPPPGPPRPAAAAATAPLANGRAGKRRPSR
LVALREQKALKTLGIIMGVFTLCWLPFFLANVVKAFHRELVPDRLFVFFNWLGYANSAFNPII
YCRSPDFRKAFQGLLCCARRAARRRHATHGDRPRASGCLARPGPPPSPGAASDDDDDDVVG
ATPPARLLEPWAGCNGGAAADSDSSLDEPCRPGFASESKV
(SEQ ID NO: 1045)

TABLE 4-continued

Targets from which the Analogs are derived

>gi|4557267|ref|NP_000016.1|adrenergic, beta-3-, receptor {Homo sapiens}
MAPWPHENSSLAPWPDLPTLAPNTANTSGLPGVPWEAALAGALLALAVLATVGGNLLVIVA
IAWTPRLQTMTNVFVTSLAAADLVMGLLVVPPAATLALTGHWPLGATGCELWTSVDVLCV
TASIETLCALAVDRYLAVTNPLRYGALVTKRCARTAVVLVWVVSAAVSFAPIMSQWWRVG
ADAEAQRCHSNPRCCAFASNMPYVLLSSSVSFYLPLLVMLFVYARVFVVATRQLRLLRGEL
GRFPPEESPPAPSRSLAPAPVGTCAPPEGVPACGRRPARLLPLREHRALCTLGLIMGTFTLCWL
PFFLANVLRALGGPSLVPGPAFLALNWLGYANSAFNPLIYCRSPDFRSAFRRLLCRCGRRLPP
EPCAAARPALFPSGVPAARSSPAQPRLCQRLDGASWGVS
(SEQ ID NO: 1046)

>gi|4557345|ref|NP_000045.1|vasopressin V2 receptor isoform 1 {Homo sapiens}
MLMASTTSAVPGHPSLPSLPSNSSQERPLDTRDPLLARAELALLSIVFVAVALSNGLVLAALA
RRGRRGHWAPIHVFIGHLCLADLAVALFQVLPQLAWKATDRFRGPDALCRAVKYLQMVGM
YASSYMILAMTLDRHRAICRPMLAYRHGSGAHWNRPVLVAWAFSLLLSLPQLFIFAQRNVE
GGSGVTDCWACFAEPWGRRTYVTWIALMVFVAPTLGIAACQVLIFREIHASLVPGPSERPGG
RRRGRRTGSPGEGAHVSAAVAKTVRMTLVIVVVYVLCWAPFFLVQLWAAWDPEAPLEGAP
FVLLMLLASLNSCTNPWIYASFSSSVSSELRSLLCCARGRTPPSLGPQDESCTTASSSLAKDTSS
(SEQ ID NO: 1047)

>gi|4557359|ref|NP_000614.1|B2 bradykinin receptor {Homo sapiens}
MFSPWKISMFLSVREDSVPTTASFSADMLNVTLQGPTLNGTFAQSKCPQVEWLGWLNTIQPP
FLWVLFVLATLENIFVLSVFCLHKSSCTVAEIYLGNLAAADLILACGLPFWAITISNNFDWLFG
ETLCRVVNAIISMNLYSSICFLMLVSIDRYLALVKTMSMGRMRGVRWAKLYSLVIWGCTLLL
SSPMLVFRTMKEYSDEGHNVTACVISYPSLIWEVFTNMLLNVVGFLLPLSVITFCTMQIMQVL
RNNEMQKFKEIQTERRATVLVLVVLLLFIICWLPFQISTFLDTLHRLGILSSCQDERIIDVITQIA
SFMAYSNSCLNPLVYVIVGKRFRKKSWEVYQGVCQKGGCRSEPIQMENSMGTLRTSISVERQ
IHKLQDWAGSRQ
(SEQ ID NO: 1048)

>gi|4557547|ref|NP_000106.1|endothelin B receptor isoform 1 precursor {Homo sapiens}
MQPPPSLCGRALVALVLACGLSRIWGEERGFPPDRATPLLQTAEIMTPPTKTLWPKGSNASLA
RSLAPAEVPKGDRTAGSPPRTISPPPCQGPIEIKETFKYINTVVSCLVFVLGIIGNSTLLRIIYKN
KCMRNGPNILIASLALGDLLHIVIDIPINVYKLLAEDWPFGAEMCKLVPFIQKASVGITVLSLC
ALSIDRYRAVASWSRIKGIGVPKWTAVEIVLIWVVSVVLAVPEAIGFDIITMDYKGSYLRICLL
HPVQKTAFMQFYKTAKDWWLFSFYFCLPLAITAFFYTLMTCEMLRKKSGMQIALNDHLKQR
REVAKTVFCLVLVFALCWLPLHLSRILKLTLYNQNDPNRCELLSFLLVLDYIGINMASLNSCI
NPIALYLVSKRFKNCFKSCLCCWCQSFEEKQSLEEKQSCLKFKANDHGYDNFRSSNKYSSS
(SEQ ID NO: 1049)

>gi|4557857|ref|NP_001040.1|somatostatin receptor type 1 {Homo sapiens}
MFPNGTASSPSSSPSPSPGSCGEGGGSRGPGAGAADGMEEPGRNASQNGTLSEGQGSAILISFI
YSVVCLVGLCGNSMVIYVILRYAKMKTATNIYILNLAIADELLMLSVPFLVTSTLLRHWPFGA
LLCRLVLSVDAVNMFTSIYCLTVLSVDRYVAVVHPIKAARYRRPTVAKVVNLGVWVLSLLV
ILPIVVFSRTAANSDGTVACNMLMPEPAQRWLVGFVLYTFLMGFLLPVGAICLCYVLIIAKM
RMVALKAGWQQRKRSERKITLMVMMVMVFVICWMPFYVVQLVNVFAEQDDATVSQLSV
ILGYANSCANPILYGFLSDNFKRSFQRILCLSWMDNAAEEPVDYYATALKSRAYSVEDFQPE
NLESGGVFRNGTCTSRITTL
(SEQ ID NO: 1050)

>gi|4557859|ref|NP_001041.1|somatostatin receptor type 2 {Homo sapiens}
MDMADEPLNGSHTWLSIPFDLNGSVVSTNTSNQTEPYYDLTSNAVLTFIYFVVCIIGLCGNTL
VIYVILRYAKMKTITNIYILNLAIADELFMLGLPFLAMQVALVHWPFGKAICRVVMTVDGINQ
FTSIFCLTVMSIDRYLAVVHPIKSAKWRRPRTAKMITMAVWGVSLLVILPIMIYAGLRSNQW
GRSSCTINWPGESGAWYTGFIIYTFILGFLVPLTIICLCYLFIIIKVKSSGIRVGSSKRKKSEKKVT
RMVSIVVAVFIFCWLPFYIFNVSSVSMAISPTPALKGMFDFVVVLTYANSCANPILYAFLSDNF
KKSFQNVLCLVKVSGTDDGERSDSKQDKSRLNETTETQRTLLNGDLQTSI
(SEQ ID NO: 1051)

>gi|4557861|ref|NP_001042.1|somatostatin receptor type 3 {Homo sapiens}
MDMLHPSSVSTTSEPENASSAWPPDATLGNVSAGPSPAGLAVSGVLIPLVYLVVCVVGLLGN
SLVIYVVLRHTASPSVTNVYILNLALADELFMLGLPFLAAQNALSYWPFGSLMCRLVMAVD
GINQFTSIFCLTVMSVDRYLAVVHPTRSARWRTAPVARTVSAAVWVASAVVVLPVVVFSGV
PRGMSTCHMQWPEPAAAWRAGFIIYTAALGFFGPLLVICLCYLLIVVKVRSAGRRVWAPSCQ
RRRSERRVTRMVVAVVALFVLCWMPFYVLNIVNVVCPLPEEPAFFGLYFLVVALPYANSC
ANPILYGFLSYRFKQGFRRVLLRPSRRVRSQEPTVGPPEKTEEEDEEEEDGEESREGGKGKEM
NGRVSQITQPGTSGQERPPSRVASKEQQLLPQEASTGEKSSTMRISYL
(SEQ ID NO: 1052)

>gi|4557865|ref|NP_001044.1|somatostatin receptor type 5 {Homo sapiens}
MEPLFPASTPSWNASSPGAASGGGDNRTLVGPAPSAGARAVLVPVLYLLVCAAGLGGNTLVI
YVVLRFAKMKTVTNIYILNLAVADVLYMLGLPFLATQNAASFWPFGPVLCRLVMTLDGVNQ
FTSVFCLTVMSVDRYLAVVHPLSSARWRRPRVAKLASAAAWVLSLCMSLPLLVFADVQEGG
TCNASWPEPVGLWGAVFIIYTAVLGFFAPLLVICLCYLLIVVKVRAAGRVRGCVRRRSERKV
TRMVLVVVLVFAGCWLPFFTVNIVNLAVALPQEPASAGLYFFVVILSYANSCANPVLYGFLS
DNFRQSFQKVLCLRKGSGAKDADATEPRPDRIRQQQEATPPAHRAAANGLMQTSKL
(SEQ ID NO: 1053)

TABLE 4-continued

Targets from which the Analogs are derived

>gi|4757888|ref|NP_004045.1|C3a anaphylatoxin chemotactic receptor {Homo sapiens}
MASFSAETNSTDLLSQPWNEPPVILSMVILSLTFLLGLPGNGLVLWVAGLKMQRTVNTIWFL
HLTLADLLCCLSLPFSLAHLALQGQWPYGRFLCKLIPSIIVLNMFASVFLLTAISLDRCLVVFK
PIWCQNHRNVGMACSICGCIWVVAFVMCIPVFVYREIFTTDNHNRCGYKFGLSSSLDYPDFY
GDPLENRSLENIVQPPGEMNDRLDPSSFQTNDHPWTVPTVFQPQTFQRPSADSLPRGSARLTS
QNLYSNVFKPADVVSPKIPSGFPIEDHETSPLDNSDAFLSTHLKLFPSASSNSFYESELPQGFQD
YYNLGQFTDDDQVPTPLVAITITRLVVGFLLPSVIMIACYSFIVFRMQRGRFAKSQSKTFRVA
VVVVAVFLVCWTPYHIFGVLSLLTDPETPLGKTLMSWDHVCIALASANSCFNPFLYALLGKD
FRKKARQSIQGILEAAFSEELTRSTHCPSNNVISERNSTTV
(SEQ ID NO: 1054)

>gi|4758014|ref|NP_004063.1|chemokine receptor-like 1 isoform b {Homo sapiens}
MEDEDYNTSISYGDEYPDYLDSIVVLEDLSPLEARVTRIFLVVVYSIVCFLGILGNGLVIIIATF
KMKKTVNMVWFLNLAVADFLFNVFLPIHITYAAMDYHWVFGTAMCKISNFLLIHNMFTSVF
LLTIISSDRCISVLLPVWSQNHRSVRLAYMACMVIWVLAFFLSSPSLVFRDTANLHGKISCFNN
FSLSTPGSSSWPTHSQMDPVGYSRHMVVTVTRFLCGFLVPVLIITACYLTIVCKLQRNRLAKT
KKPFKIIVTIIITFFLCWCPYHTLNLLELHHTAMPGSVFSLGLPLATALAIANSCMNPILYVFMG
QDFKKFKVALFSRLVNALSEDTGHSSYPSHRSFTKMSSMNERTSMNERETGML
(SEQ ID NO: 1055)

>gi|4758326|ref|NP_004092.1|proteinase-activated receptor 3 precursor {Homo sapiens}
MKALIFAAAGLLLLLPTFCQSGMENDTNNLAKPTLPIKTFRGAPPNSFEEFPFSALEGWTGATI
TVKIKCPEESASHLHVKNATMGYLTSSLSTKLIPAIYLLVFVVQPANAVTLWMLFFRTRSIC
TTVFYTNLAIADFLFCVTLPFKIAYHLNGNNWVFGEVLCRATTVIFYGNMYCSILLLACISINR
YLAIVHPFTYRGLPKHTYALVTCGLVWATVFLYMLPFFILKQEYYLVQPDITTCHDVHNTCE
SSSPFQLYYFISLAFFGFLIPFVLIIYCYAAIIRTLNAYDHRWLWYVKASLLILVIFTICFAPSNIIL
IIHHANYYYNNTDGLYFIYLIALCLGSLNSCLDPFLYFLMSKTRNHSTAYLTK
(SEQ ID NO: 1056)

>gi|4758438|ref|NP_004237.1|glucagon-like peptide 2 receptor precursor {Homo sapiens}
MKLGSSRAGPGRGSAGLLPGVHELPMGIPAPWGTSPLSFHRKCSLWAPGRPPFLTLVLLVSIKQ
VTGSLLEETTRKWAQYKQACLRDLLKEPSGIFCNGTFDQYVCWPHSSPGNVSVPCPSYLPW
WSEESSGRAYRHCLAQGTWQTIENATDIWQDDSECSENHSFKQNVDRYALLSTLQLMYTVG
YSFSLISLFLALTLLLFLRKLHCTRNYIHMNLFASFILRTLAVLVKDVVFYNSYSKRPDNENG
WMSYLSEMSTSCRSVQVLLHYFVGANYLWLLVEGLYLHTLLEPTVLPERRLWPRYLLLGW
AFPVLFVVPWGFARAHLENTGCWTTNGNKKIWWIIRGPMMLCVTVNFFIFLKILKLLISKLK
AHQMCFRDYKYRLAKSTLVLIPLLGVHEILFSFITDDQVEGFAKLIRLFIQLTLSSFHGFLVAL
QYGFANGEVKAELRKYWVRFLLARHSGCRACVLGKDPRFLGKCPKKLSEGDGAEKLRKLQ
PSLNSGRLLHLAMRGLGELGAPQQDHARWPRGSSLSECSEGDVTMANTMEEILEESEI
(SEQ ID NO: 1057)

>gi|4758474|ref|NP_004239.1|prolactin-releasing peptide receptor {Homo sapiens}
MASSTTRGPRVSDLFSGLPPAVTTPANQSAEASAGNGSVAGADAPAVTPFQSLQLVHQLKGL
IVLLYSVVVVVGLVGNCLLVLVIARVRRLHNVTNFLIGNLASLSDVLMCTACVPLTLAYAFEP
RGWVFGGGLCHLVFFLQPVTVYVSVFTLTTIAVDRYVVLVHPLRRRISLRLSAYAVLAIWAL
SAVLALPAAVHTYHVELKPHDVRLCEEFWGSQERQRQLYAWGLLLVTYLLPLLVILLSYVR
VSVKLRNRVVPGCVTQSQADWDRARRRRTFCLLVVVVVVFAVCWLPLHVFNLLRDLDPHA
IDPYAFGLVQLLCHWLAMSSACYNPFIYAWLHDSFREELRKLLVAWPRKIAPHGQNMTVSV
VI
(SEQ ID NO: 1058)

>gi|4758864|ref|NP_004145.1|pyrimidinergic receptor P2Y6 {Homo sapiens}
MEWDNGTGQALGLPPTTCVYRENFKQLLLPPVYSAVLAAGLPLNICVITQICTSRRALTRTA
VYTLNLALADLLYACSLPLLIYNYAQGDHWPFGDFACRLVRFLFYANLHGSILFLTCISFQRY
LGICHPLAPWHKRGGRRAAWLVCVAVWLAVTTQCLPTAIFAATGIQRNRTVCYDLSPPALA
THYMPYGMALTVIGFLLPFAALLACYCLLACRLCRQDGPAEPVAQERRGKAARMAVVVAA
AFAISFLPFHITKTAYLAVRSTPGVPCTVLEAFAAAYKGTRPFASANSVLDPILFYFTQKKFRR
RPHELLQKLTAKWQRQGR
(SEQ ID NO: 1059)

>gi|4826706|ref|NP_004942.1|G-protein coupled receptor 183 {Homo sapiens}
MDIQMANNFTPPSATPQGNDCDLYAHHSTARIVMPLHYSLVFIIGLVGNLLALVVIVQNRKKI
NSTTLYSTNLVISDILFTTALPTRIAYYAMGFDWRIGDALCRITALVFYINTYAGVNFMTCLSI
DRFIAVVHPLRYNKIRIEHAKGVCIFVWILVFAQTLPLLINPMSKQEAERITCMEYPNFEETK
SLPWILLGACFIGYVLPLIIILICYSQICCKLFRTAKQNPLTEKSGVNKKALNTIILIIVVFVLCFT
PYHVAIIQHMIKKLRFSNFLECSQRHSFQISLHFTVCLMNFNCCMDPFIYFFACKGYKRKVMR
MLKRQVSVSISSAVKSAPEENSREMTETQMMIHSKSSNGK
(SEQ ID NO: 1060)

>gi|4826954|ref|NP_005039.1|parathyroid hormone 2 receptor precursor {Homo sapiens}
MAGLGASLHVWGWLMLGSCLLARAQLDSDGTITIEEQIVLVLKAKVQCELNITAQLQEGEG
NCFPEWDGLICWPRGTVGKISAVPCPPYIYDFNHKGVAFRHCNPNGTWDFMHSLNKTWANY
SDCLRFLQPDISIGKQEFFERLYVMYTVGYSISFGSLAVAILIIGYFRRLHCTRNYIHMHLFVSF
MLRATSIFVKDRVVHAHIGVKELESLIMQDDPQNSIEATSVDKSQYIGCKIAVVMFIYFLATN
YYWILVEGLYLHNLIFVAFFSDTKYLWGFILIGWGFPAAFVAAWAVARATLADARCWELSA
GDIKWIYQAPILAAIGLNFILFLNTVRVLATKIWETNAVGHDTRKQYRKLAKSTLVLVLVFGV
HYIVFVCLPHSFTGLGWEIRMHCELFFNSFQGFFVSIIYCYCNGEVQAEVKKMWSRWNLSVD TABLE 4-continued Targets from which the Analogs are derived WKRTPPCGSRRCGSVLTTVTHSTSSQSQVAASTRMVLISGKAAKIASRQPDSHITLPGYVWSN
SEQDCLPHSFHEETKEDSGRQGDDILMEKPSRPMESNPDTEGCQGETEDVL
(SEQ ID NO: 1061)

>gi|4885057|ref|NP_005152.1|apelin receptor {Homo sapiens}
MEEGGDFDNYYGADNQSECEYTDWKSSGALIPAIYMLVFLLGTTGNGLVLWTVFRSSREKR
RSADIFIASLAVADLTFVVTLPLWATYTYRDYDWPFGTFFCKLSSYLIFVNMYASVFCLTGLS
FDRYLAIVRPVANARLRLRVSGAVATAVLWVLAALLAMPVMVLRTTGDLENTTKVQCYMD
YSMVATVSSEWAWEVGLGVSSTTVGFVVPFTIMLTCYFFIAQTIAGHFRKERIEGLRKRRRLL
SIIVVLVVTFALCWMPYHLVKTLYMLGSLLHWPCDFDLFLMNIFPYCTCISYVNSCLNPFLYA
FFDPRFRQACTSMLCCGQSRCAGTSHSSSGEKSASYSSGHSQGPGPNMGKGGEQMHEKSIPY
SQETLVVD
(SEQ ID NO: 1062)

>gi|4885121|ref|NP_005192.1|C-C chemokine receptor type 8 {Homo sapiens}
MDYTLDLSVTTVTDYYYPDIFSSPCDAELIQTNGKLLLAVFYCLLFVFSLLGNSLVILVLVVC
KKLRSITDVYLLNLALSDLLFVFSFPFQTYYLLDQWVFGTVMCKVVSGFYYIGFYSSMFFITL
MSVDRYLAVVHAVYALKVRTIRMGTTLCLAVWLTAIMATIPLLVFYQVASEDGVLQCYSFY
NQQTLKWKIFTNFKMNILGLLIPFTIFMFCYIKILHQLKRCQHNKTKAIRLVLIVVIASLLFW
VPFNVVLFLTSLHSMHILDGCSISQQLYTATHVTEIISFTHCCVNPVIYAFVGEKFKKHLSEIFQ
KSCSQIFNYLGRQMPRESCEKSSSCQQHSSRSSSVDYIL
(SEQ ID NO: 1063)

>gi|4885295|ref|NP_005279.1|G-protein coupled receptor 12 {Homo sapiens}
MNEDLKVNLSGLPRDYLDAAAAENISAAVSSRVPAVEPEPELVVNPWDIVLCTSGTLISCEN
AIVVLIIFHNPSLRAPMFLLIGSLALADLLAGIGLITNFVFAYLLQSEATKLVTIGLIVASFSASV
CSLLAITVDRYLSLYYALTYHSERTVTFTYVMLVMLWGTSICLGLLPVMGWNCLRDESTCS
VVRPLTKNNAAILSVSFLFMFALMLQLYIQICKIVMRHAHQIALQHHFLATSHYVTTRKGVST
LAIILGTFAACWMPFTLYSLIADYTYPSIYTYATLLPATYNSIINPVIYAFRNQEIQKALCLICCG
CIPSSLAQRARSPSDV
(SEQ ID NO: 1064)

>gi|4885299|ref|NP_005281.1|G protein-coupled receptor 15 {Homo sapiens}
MDPEETSVYLDYYYATSPNSDIRETHSHVPYTSVFLPVFYTAVFLTGVLGNLVLMGALHFKP
GSRRLIDIFIINLAASDFIFLVTLPLWVDKEASLGLWRTGSFLCKGSSYMISVNMHCSVLLLTC
MSVDRYLAIVWPVVSRKFRRTDCAYVVCASIWFISCLLGLPTLLSRELTLIDDKPYCAEKKAT
PIKLIWSLVALIFTFFVPLLSIVTCYCCIARKLCAHYQQSGKHNKKLKKSIKIIFIVVAAFLVSW
LPFNTFKFLAIVSGLRQEHYLPSAILQLGMEVSGPLAFANSCVNPFIYYIFDSYIRRAIVHCLCP
CLKNYDFGSSTETSDSHLTKALSTFIHAEDFARRRKRSVSL
(SEQ ID NO: 1065)

>gi|4885301|ref|NP_005282.1|uracil nucleotide/cysteinyl leukotriene receptor isoform a {Homo sapiens}
MSKRSWWAGSRKPPREMLKLSGSDSSQSMNGLEVAPPGLITNFSLATAEQCGQETPLENMLF
ASFYLLDFILALVGNTLALWLFIRDHKSGTPANVFLMHLAVADLSCVLVLPTRLVYHFSGNH
WPFGEIACRLTGFLFYLNMYASIYFLTCISADRFLAIVHPVKSLKLRRPLYAHLACAFLWVVV
AVAMAPLLVSPQTVQTNHTVVCLQLYREKASHHALVSLAVAFTFPFITTVTCYLLIIRSLRQG
LRVEKRLKTKAVRMIAIVLAIFLVCFVPYHVNRSVYVLHYRSHGASCATQRILALANRITSCL
TSLNGALDPIMYFFVAEKFRHALCNLLCGKRLKGPPPSFEGKTNESSLSAKSEL
(SEQ ID NO: 1066)

>gi|4885307|ref|NP_005285.1|G protein-coupled receptor 21 {Homo sapiens}
MNSTLDGNQSSHPFCLLAFGYLETVNFCLLEVLIIVFLTVLIISGNIIVIFVFHCAPLLNHHTTSY
FIQTMAYADLFVGVSCVVPSLSLLHHPLPVEESLTCQIFGFVVSVLKSVSMASLACISIDRYIAI
TKPLTYNTLVTPWRLRLCIFLIWLYSTLVFLPSFFHWGKPGYHGDVFQWCAESWHTDSYFTL
FIVMMLYAPAALIVCFTYFNIFRICQQHTKDISERQARFSSQSGETGEVQACPDKRYAMVLFRI
TSVFYILWLPYIIYFLLESSTGHSNRFASFLTTWLAISNSFCNCVIYSLSNSVFQRGLKRLSGAM
CTSCASQTTANDPYTVRSKGPLNGCHI
(SEQ ID NO: 1067)

>gi|4885311|ref|NP_005287.1|lysophosphatidic acid receptor 4 {Homo sapiens}
MGDRRFIDFQFQDSNSSLRPRLGNATANNTCIVDDSFKYNLNGAVYSVVFILGLITNSVSLFV
FCFRMKMRSETAIFITNLAVSDLLFVCTLPFKIFYNFNRHWPFGDTLCKISGTAFLTNIYGSML
FLTCISVDRFLAIVYPERSRTIRTRRNSAIVCAGVWILVLSGGISASLFSTTNVNNATTTCFEGF
SKRVWKTYLSKITIFIEVVGFIIPLILNVSCSSVVLRTLRKPATLSQIGTNKKKVLKMITVHMAV
FVVCFVPYNSVLFYLALVRSQAITNCFLERFAKIMYPITLCLATLNCCFDPFIYYFTLESFQKSF
YINAHIRMESLFKTETPLTTKPSLPAIQEEVSDQTTNNGGELMLESTF
(SEQ ID NO: 1068)

>gi|4885319|ref|NP_005291.1|probable G-protein coupled receptor 34 {Homo sapiens}
MRSHTIMTTTSVSSWPYSSHRMRFITNHSDQPPQNFSATPNVTTCPMDEKLLSTVLTTSYSVI
FIVGLVGNIIALYVFLGIHRKRNSIQIYLLNVAIADLLLIFCLPFRIMYHINQNKWTLGVILCKV
VGTLFYMNMYISIILLGFISLDRYIKINRSIQQRKAITTKQSIYVCCIVWMLALGGFLTMIILTLK
KGGHNSTMCFHYRDKHNAKGEAIFNFILVVMFWLIFLLIILSYIKIGKNLLRISKRRSKFPNSG
KYATTARNSFIVLIIFTICFVPYHAFRFIYISSQLNVSSCYWKEIVHKTNEIMLVLSSFNSCLDPV
MYFLMSSNIRKIMCQLLFRRFQGEPSRSESTSEFKPGYSLHDTSVAVKIQSSSKST
(SEQ ID NO: 1069)

TABLE 4-continued

Targets from which the Analogs are derived

>gi|4885323|ref|NP_005293.1|probable G-protein coupled receptor 37 precursor {Homo sapiens}
MRAPGALLARMSRLLLLLLKVSASSALGVAPASRNETCLGESCAPTVIQRRGRDAWGPGNS
ARDVLRARAPREEQGAAFLAGPSWDLPAAPGRDPAAGRGAEASAAGPPGPPTRPPGPWRW
KGARGQEPSETLGRGNPTALQLFLQISEEEEKGPRGAGISGRSQEQSVKTVPGASDLFYWPRR
AGKLQGSHHKPLSKTANGLAGHEGWTIALPGRALAQNGSLGEGIHEPGGPRRGNSTNRRVR
LKNPFYPLTQESYGAYAVMCLSVVIFGTGIIGNLAVMCIVCHNYYMRSISNSLLANLAFWDF
LIIFFCLPLVIFHELTKKWLLEDFSCKIVPYIEVASLGVTTFTLCALCIDRFRAATNVQMYYEMI
ENCSSTTAKLAVIWVGALLLALPEVVLRQLSKEDLGFSGRAPAERCIIKISPDLPDTIYVLALT
YDSARLWWYFGCYFCLPTLFTITCSLVTARKIRKAEKACTRGNKRQIQLESQMNCTVVALTI
LYGFCIIPENICNIVTAYMATGVSQQTMDLLNIISQFLLFFKSCVTPVLLFCLCKPFSRAFMECC
CCCCEECIQKSSTVTSDDNDNEYTTELELSPFSTIRREMSTFASVGTHC
(SEQ ID NO: 1070)

>gi|4885325|ref|NP_905272.1|G protein-coupled receptor 3 {Homo sapiens}
MMWGAGSPLAWLSAGSGNVNVSSVGPAEGPTGPAAPLPSPKAWDVVLCISGTLVSCENALV
VAIIVGTPAFRAPMFLLVGSLAVADLLAGLGLVLHFAAVFCIGSAEMSLVLVGVLAMAFTASI
GSLLAITVDRYLSLYNALTYYSETTVTRTYVMLALVWGGALGLGLLPVLAWNCLDGLTTCG
VVYPLSKNHLVVLAIAFFMVFGIMLQLYAQICRIVCRHAQQIALQRHLLPASHYVATRKGIAT
LAVVLGAFAACWLPFTVYCLLGDAHSPPLYTYLTLLPATYNSMINPIIYAFRNQDVQKVLWA
VCCCCSSSKIPFRSRSPSDV
(SEQ ID NO: 1071)

>gi|4885327|ref|NP_005294.1|free fatty acid receptor 1 {Homo sapiens}
MDLPPQLSFGLYVAAFALGFPLNVLAIRGATAHARLRLTPSLVYALNLGCSDLLLTVSLPLKA
VEALASGAWPLPASLCPVFAVAHFFPLYAGGGFLAALSAGRYLGAAFPLGYQAFRRPCYSW
GVCAAIWALVLCHLGLVFGLEAPGGWLDHSNTSLGINTPVNGSPVCLEAWDPASAGPARFS
LSLLLFFLPLAITAFCYVGCLRALARSGLTHRRKLRAAWVAGGALLTLLLCVGPYNASNVAS
FLYPNLGGSWRKLGLITGAWSVVLNPLVTGYLGRGPGLKTVCAARTQGGKSQK
(SEQ ID NO: 1072)

>gi|4885329|ref|NP_005295.1|free fatty acid receptor 3 {Homo sapiens}
MDTGPDQSYFSGNHWFVFSVYLLTFLVGLPLNLLALVVFVGKLQRRPVAVDVLLLNLTASD
LLLLLFLPFRMVEAANGMHWPLPFILCPLSGFIFFTTIYLTALFLAAVSIERFLSVAHPLWYKT
RPRLGQAGLVSVACWLLASAHCSVVYVIEFSGDISHSQGTNGTCYLEFRKDQLAILLPVRLE
MAVVLFVVPLIITSYCYSRLVWILGRGGSHRRQRRVAGLLAATLLNFLVCFGPYNVSHVVGY
ICGESPAWRIYVTLLSTLNSCVDPFVYYFSSSGFQADFHELLRRLCGLWGQWQQESSMELKE
QKGGEEQRADRPAERKTSEHSQGCGTGGQVACAES
(SEQ ID NO: 1073)

>gi|4885333|ref|NP_005297.1|free fatty acid receptor 2 {Homo sapiens}
MLPDWKSSLILMAYIIIFLTGLPANLLALRAFVGRIRQPQPAPVHILLLSLTLADLLLLLLLPFKI
IEEAASNFRWYLPKVVCALTSFGFYSSIYCSTWLLAGISIERYLGVAPPVQYKLSRRPLYGVIAA
LVAWVMSFGHCTIVIIVQYLNTTEQVRSGNEITCYENFTDNQLDVVLPVRLELCLVLFFIPMA
VTIFCYWRFVWIMLSQPLVGAQRRRRAVGLAVVTLLNFLVCFGPYNVSHLVGYHQRKSPW
WRSIAVVFSSLNASLDPLLFYFSSSVVRRAFGRGLQVLRNQGSSLLGRRGKDTAEGTNEDRG
VGQGEGMPSSDFTTE
(SEQ ID NO: 1074)

>gi|4885335|ref|NP_005273.1|G-protein coupled receptor 4 {Homo sapiens}
MGNHTWEGCHVDSRVDHLFPPSLYIFVIGVGLPTNCLALWAAYRQVQQRNELGVYLMNLSI
ADLLYICTLPLWVDYFLHHDNWIHGPGSCKLFGFIFYTNIYISIAFLCCISVDRYLAVAHPLRF
ARLRRVKTAVAVSSVVWATELGANSAPLFHDELFRDRYNHTFCFEKFPMEGWVAWMNLYR
VFVGFLFPWALMLLSYRGILRAVRGSVSTERQEKAKIKRLALSLIAIVLVCFAPYHVLLLSRS
AIYLGRPWDCGFEERVFSAYHSSLAFTSLNCVADPILYCLVNEGARSDVAKALHNLLRFLAS
DKPQEMANASLTLETPLTSKRNSTAKAMTGSWAATPPSQGDQVQLKMLPPAQ
(SEQ ID NO: 1075)

>gi|4885339|ref|NP_005274.1|chemokine XC receptor 1 {Homo sapiens}
MESSGNPESTTFFYDLQSQPCENQAWVFATLATTVLYCLVFLLSLVGNSLVLWVLVKYESL
ESLTNIFILNLCLSDLVFACLLPVWISPYHWGWVLGDFLCKLLNMIFSISLYSSIFFLTIMTIHRY
LSVVSPLSTLRVPTLRCRVLVTMAVWVASILSSILDTIFHKVLSSGCDYSELTWYLTSVYQHN
LFFLLSLGIILFCYVEILRTLFRSRSKRRHRTVKLIFAIVVAYFLSWGPYNFTLFLQTLFRTQIIRS
CEAKQQLEYALLICRNLAFSHCCFNPVLYVFVGVKFRTHLKHVLRQFWFCRLQAPSPASIPHS
PGAFAYEGASFY
(SEQ ID NO: 1076)

>gi|4885341|ref|NP_005275.1|G-protein coupled receptor 6 {Homo sapiens}
MNASAASLNDSQVVVVAAEGAAAAATAAGGPDTGEWGPPAAAALGAGGGANGSLELSSQ
LSAGPPGLLLPAVNPWDVLLCVSGTVIAGENALVVALIASTPALRTPMFVLVGSLATADLLA
GCGLILHFVFQYLVPSETVSLLTVGFLVASFAASVSSLLAITVDRYLSLYNALTYYSRRTLLGV
HLLLAATWTVSLGLGLLPVLGWNCLAERAACSVVRPLARSHVALLSAAFFMVFGIMLHLYV
RICQVVWRHAHQIALQQHCLAPPHLAATRKGVGTLAVVLGTFGASWLPFAIYCVVGSHEDP
AVYTYATLLPATYNSMINPIIYAFRNQEIQRALWLLLCGCFQSKVPFRSRSPSEV
(SEQ ID NO: 1077)

>gi|4885361|ref|NP_005305.1|gastrin-releasing peptide receptor {Homo sapiens}
MALNDCFLLNLEVDHFMHCNISSHSADLPVNDDWSHPGILYVIPAVYGVIILIGLIGNITLIKIF
CTVKSMRNVPNLFISSLALGDLLLLITCAPVDASRYLADRWLFGRIGCKLIPFIQLTSVGVSVF TABLE 4-continued Targets from which the Analogs are derived TLTALSADRYKAIVRPMDIQASHALMKICLKAAFIWIISMLLAIPEAVFSDLHPFHEESTNQTFI
SCAPYPHSNELHPKIHSMASFLVFYVIPLSIISVYYYFIAKNLIQSAYNLPVEGNIHVKKQIESR
KRLAKTVLVFVGLFAFCWLPNHVIYLYRSYHYSEVDTSMLHFVTSICARLLAFTNSCVNPFA
LYLLSKSFRKQFNTQLLCCQPGLIIRSHSTGRSTTCMTSLKSTNPSVATFSLINGNICHERYV
(SEQ ID NO: 1078)

>gi|5031621|ref|NP_405786.1|calcitonin gene-related peptide type 1 receptor precursor {Homo sapiens}
MEKKCTLYFLVLLPFFMILVTAELEESPEDSIQLGVTRNKIMTAQYECYQKIMQDPIQQAEGV
YCNRTWDGWLCWNDVAAGTESMQLCPDYFQDFDPSEKVTKICDQDGNWFRHPASNRTWT
NYTQCNVNTHEKVKTALNLFYLTIIGHGLSIASLLISLGIFFYFKSLSCQRITLHKNLFFSFVCN
SVVTIIHLTAVANNQALVATNPVSCKVSQFIHLYLMGCNYFWMLCEGIYLHTLIVVAVFAEK
QHLMWYYFLGWGFPLIPACIHAIARSLYYNDNCWISSDTHLLYIIHGPICAALLVNLFFLLNIV
RVLITKLKVTHQAESNLYMKAVRATLILVPLLGIEFVLIPWRPEGKIAEEVYDYIMHILMHFQ
GLLVSTIFCFFNGEVQAILRRNWNQYKIQFGNSFSNSEALRSASYTVSTISDGPYSHDCPSEH
LNGKSIHDIENVLLKPENLYN
(SEQ ID NO: 1079)

>gi|5031627|ref|NP_005499.1|C-C chemokine receptor type 4 {Homo sapiens}
MNPTDIADTTLDESIYSNYYLYESIPKPCTKEGIKAFGELFLPPLYSLVFVFGLLGNSVVVLVL
FKYKRLRSMTDVYLLNLAISDLLFVFSLPFWGYYAADQWVFGLGLCKMISWMYLVGFYSGI
FFVMLMSIDRYLAIVHAVFSLRARTLTYGVITSLATWSVAVFASLPGFLFSTCYTERNHTYCK
TKYSLNSTTWKVLSSLEINILGLVIPLGIMLFCYSMIIRTLQHCKNEKKNKAVKMIFAVVVLFL
GFWTPYNIVLFLETLVELEVLQDCTFERYLDYAIQATETLAFVHCCLNPIIYFFLGEKFRKYIL
QLFKTCRGLFVLCQYCGLLQIYSADTPSSSYTQSTMDHDLHDAL
(SEQ ID NO: 1080)

>gi|5174535|ref|NP_005904.1|melanocortin 5 receptor {Homo sapiens}
MNSSFHLHFLDLNLNATEGNLSGPNVKNKSSPCEDMGIAVEVFLTLGVISLLENILVIGAIVKN
KNLHSPMYFFVCSLAVADMLVSMSSAWETITIYLLNNKHLVIADAFVRHIDNVFDSMICISVV
ASMCSLLAIAVDRYVTIFYALRYHHIMTARRSGAIIAGIWAFCTGCGIVFILYSESTYVILCLIS
MFFAMLFLLVSLYIHMFLLARTHVKRIAALPGASSARQRTSMQGAVTVTMLLGVFTVCWAP
FFLHLTLMLSCPQNLYCSRFMSHFNMYLILIMCNSVMDPLIYAFRSQEMRKTFKEIICCRGFRI
ACSFPRRD
(SEQ ID NO: 1081)

>gi|5174593|ref|NP_005949.1|melatonin receptor 1A {Homo sapiens}
MQGNGSALPNASQPVLRGDGARPSWLASALACVLIFTIVVDILGNLLVILSVYRNKKLRNAG
NIFVVSLAVADLVVAIYPYPLVLMSIFNNGWNLGYLHCQVSGFLMGLSVIGSIFNITGIAINRY
CYICHSLKYDKLYSSKNSLCYVLLIWLLTLAAVLPNLRAGTLQYDPRIYSCTFAQSVSSAYTI
AVVVFHFLVPMIIVIFCYLRIWILVLQVRQRVKPDRKPKLKPQDFRNFVTMFVVFVLFAICWA
PLNFIGLAVASDPASMVPRIPEWLFVASYYMAYFNSCLNAIIYGLLNQNFRKEYRRIIVSLCTA
RVFFVDSSNDVADRVKWKPSPLMTNNNVVKVDSV
(SEQ ID NO: 1082)

>gi|5174595|ref|NP_005950.1|melatonin receptor 1B {Homo sapiens}
MSENGSFANCCEAGGWAVRPGWSGAGSARPSRTPRPPWVAPALSAVLIVTTAVDVVGNLL
VILSVLRNRKLRNAGNLFLVSLALADLVVAFYPYPLILVAIFYDGWALGEEHCKASAFVMGL
SVIGSVFNITAIAINRYCYICHSMAYHRIYRRWHTPLHICLIWLLTVVALLPNFFVGSLEYDPRI
YSCTFIQTASTQYTAAVVVIHFLLPIAVVSFCYLRIWVLVLQARRKAKPESRLCLKPSDLRSFL
TMFVVFVIFAICWAPLNCIGLAVAINPQEMAPQIPEGLFVTSYLLAYFNSCLNAIVYGLLNQNF
RREYKRILLALWNPRHCIQDASKGSHAEGLQSPAPPIIGVQHQADAL
(SEQ ID NO: 1083)

>gi|5453666|ref|NP_006134.1|probable G-protein coupled receptor 19 {Homo sapiens}
MVFAHRMDNSKPHLIIPTLLVPLQNRSCTETATPLPSQYLMELSEEHSWMSNQTDLHYVLKP
GEVATASIFFGILWLFSIFGNSLVCLVIHRSRRTQSTTNYFVVSMACADLLISVASTPFVLLQFT
TGRWTLGSATCKVVRYFQYLTPGVQIYVLLSICIDRFYTIVYPLSFKVSREKAKKMIAASWIF
DAGFVTPVLFFYGSNWDSHCNYFLPSSWEGTAYTVIHFLVGFVIPSVLIILFYQKVIKYIWRIG
TDGRTVRRTMNIVPRTKVKTIKMFLILNLLFLLSWLPPHVAQLWHPEQDYKKSSLVFTAIT
WISFSSSASKPTLYSIYNANFRRGMKETFCMSSMKCYRSNAYTITTSSRMAKKNYVGISEIPS
MAKTITKDSIYDSFDREAKEKKLAWPINSNPPNTFV
(SEQ ID NO: 1084)

>gi|5453796|ref|NP_006165.1|neuropeptide Y receptor Y5 {Homo sapiens}
MDLELDEYYNKTLATENNTAATRNSDFPVWDDYKSSVDDLQYFLIGLYTFVSLLGFMGNLL
ILMALMKKRNQKTTVNFLIGNLAFSDILVVLFCSPFTLTSVLLDQWMFGKVMCHIMPFLQCV
SVLVSTLILISIAIVRYHMIKHPISNNLTANHGYFLIATVWTLGFAICSPLPVFHSLVELQETFGS
ALLSSRYLCVESWPSDSYRIAFTISLLLVQYILPLVCLTVSHTSVCRSISCGLSNKENRLEENEM
INILTLHPSKKSGPQVKLSGSHKWSYSFIKKHRRRYSKKTACVLPAPERPSQENHSRILPENFGS
VRSQLSSSSKFIPGVPTCFEIKPEENSDVHELRVKRSVTRIKKRSRSVFYRLTILILVFAVSWMP
LHLFHVVTDFNDNLISNRHFKLVYCICHLLGMMSCCLNPILYGFLNNGIKADLVSLIHCHLM
(SEQ ID NO: 1085)

>gi|5729798|ref|NP_006630.1|cysteinyl leukotriene receptor I {Homo sapiens}
MDETGNLTVSSATCHDTIDDFRNQVYSTLYSMISVVGFFGNGFVLYVLIKTYHKKSAFQVYM
INLAVADLLCVCTLPLRVVYYVHKGIWLFGDFLCRLSTYALYVNLYCSIFFMTAMSFFRCIAI
VFPVQNINLVTQKKARFVCVGIWIFVILTSSPFLMAKPQKDEKNNTKCFEPPQDNQTKNHVL TABLE 4-continued Targets from which the Analogs are derived VLHYVSLFVGFIIPFVIIIVCYTMIILTLLKKSMKKNLSSHKKAIGMIMVVTAAFLVSFMPYHIQ
RTIHLHFLHNETKPCDSVLRMQKSVVITLSLAASNCCFDPLLYFFSGGNFRKRLSTFRKHSLSS
VTYVPRKKASLPEKGEEICKV
(SEQ ID NO: 1086)

>gi|5730106|ref|NP_006555.1|C-X-C chemokine receptor type 6 {Homo sapiens}
MAEHDYHEDYGFSSFNDSSQEEHQDFLQFSKVFLPCMYLVVFVCGLVGNSLVLVISIFYHKL
QSLTDVFLVNLPLADLVFVCTLPFWAYAGIHEWVFGQVMCKSLLGIYTINFYTSMLILTCITV
DRFIVVVKATKAYNQQAKRMTWGKVTSLLIWVISLLVSLPQIIYGNVFNLDKLICGYHDEAIS
TVVLATQMTLGFFLPLLTMIVCYSVIIKTLLHAGGFQKHRSLKIIFLVMAVFLLTQMPFNLMK
FIRSTHWEYYAMTSFHYTIMVTEALAYLRACLNPVLYAFVSLKFRKNFWKLVKDIGCLPYLG
VSHQWKSSEDNSKTFSASHNVEATSMFQL
(SEQ ID NO: 1087)

>gi|5803025|ref|NP_006785.1|probable G-protein coupled receptor 75 {Homo sapiens}
MNSTGHLQDAPNATSLHVPHSQEGNSTSLQEGLQDLIHTATLVTCTFLLAVIFCLGSYGNFIV
FLSFFDPAFRKFRTNFDFMILNLSFCDLFICGVTAPMFTFVLFFSSASSIPDAFCFTFHLTSSGFII
MSLKTVAVIALHRLRMVLGKQPNRTASFPCTVLLTLLLWATSFTLATLATLKTSKSHLCLPM
SSLIAGKGKAILSLYVVDFTFCVAVVSVSYIMIAQTLRKNAQVRKCPPVITVDASRPQPFMGV
PVQGGGDPIQCAMPALYRNQNYNKLQHVQTRGYTKSPNQLVTPAASRLQLVSAINLSTAKD
SKAVVTCVIIVLSVLVCCLPLGISLVQVVLSSNGSFILYQFELFGFTLIFFKSGLNPFIYSRNSAG
LRRKVLWCLQYIGLGFFCCKQKTRLRAMGKGNLEVNRNKSSHHETNSAYMLSPKPQKKFV
DQACGPSHSKESMVSPKISAGHQHCGQSSSTPINTRIEPYYSIYNSSPSQEESSPCNLQPVNSFG
FANSYIAMHYHTTNDLVQEYDSTSAKQIPVPSV
(SEQ ID NO: 1088)

>gi|5921992|ref|NP_000666.2|adenosine receptor A2a {Homo sapiens}
MPIMGSSVYITVELAIAVLAILGNVLVCWAVWLNSNLQNVTNYFVVSLAAADIAVGVLAIPF
AITISTGFCAACHGCLFIACFVLVLTQSSIFSLLAIAIDRYIAIRIPLRYNGLVTGTRAKGIIAICW
VLSFAIGLTPMLGWNNCGQPKEGKNHSQGCGEGQVACLFEDVVPMNYMVYFNFFACVLVP
LLLMLGVYLRIFLAARRQLKQMESQPLPGERARSTLQKEVHAAKSLAIIVGLFALCWLPLHII
NCFTFFCPDCSHAPLWLMYLAIVLSHTNSVVNPFIYAYRIREFRQTFRKIIRSHVLRQQEPFKA
AGTSARVLAANGSDGEQVSLRLNGHPPGVWANGSAPHPERRPNGYALGLVSGGSAQESQG
NTGLPDVELLSHELKGVCPEPPGLDDPLAQDGAGVS
(SEQ ID NO: 1089)

>gi|6005705|ref|NP_009195.1|G-protein coupled receptor 182 {Homo sapiens}
MSVKPSWGPGPSEGVTAVPTSDLGEIHNWTELLDLFNHTLSECHVELSQSTKRVVLFALYLA
MFVVGLVENLLVICVNWRGSGRAGLMNLYILNMAIADLGIVLSLPVWMLEVTLDYTWLWG
SFSCRFTHYFYFVNMYSSIFFLVCLSVDRYVTLTSASPSWQRYQHRVRRAMCAGIWVLSAIIP
LPEVVHIQLVEGPEPMCLFMAPFETYSTWALAVALSTTILGFLLPFFPLITVFNVLTACRLRQPG
QPKSRRHCLLLCAYVAVFVMCWLPYHVTLLLLTLHGTHISLHCHLVHLLYFFYDVIDCFSML
HCVINPILYNFLSPHFRGRLLNAVVHYLPKDQTKAGTCASSSSCSTQHSIIITKGDSQPAAAAP
HPEPSLSFQAHHLLPNTSPISPTQPLTPS
(SEQ ID NO: 1090)

>gi|6323236|ref|NP_013308.1|Hrd3p {Saccharomyces cerevisiae}
MITLLLYLCVICNAIVLIRADSIADPWPEARHLLNTIAKSRDPMKEAAMEPNADEFVGFYVPM
DYSPRNEEKNYQSIWQNEITDSQRHIYELLVQSSEQFNNSEATYTLSQIHLWSQYNFPHNMTL
AHKYLEKFNDLTHFTNHSAIFDLAVMYATGGCASGNDQTVIPQDSAKALLYYQRAAQLGNL
KAKQVLAYKYYSGFNVPRNFHKSLVLYRDIAEQLRKSYSRDEWDIVFPYWESYNVRISDFES
GLLGKGLNSVPSSTVRKRTTRPDIGSPFIAQVNGVQMTLQIEPMGRFAFNGNDGNINGDEDD
EDASERRIIRIYYAALNDYKGTYSQSRNCERAKNLLELTYKEFQPHVDNLDPLQVFYYVRCL
QLLGHMYFTGEGSSKPNIHMAEEILTTSLEISRRAQGPIGRACIDLGLINQYITNNISQAISYYM
KAMKTQANNGIVEFQLSKLATSFPEEKIGDPFNLMETAYLNGFIPAIYEFAVMIESGMNSKSS
VENTAYLFKTFVDKNEAIMAPKLRTAFAALINDRSEVALWAYSQLAEQGYETAQVSAAYLM
YQLPYEFEDPPRTTDQRKTLAISYYTRAFKQGNIDAGVVAGDIYFQMQNYSKAMALYQGAA
LKYSIQAIWNLGYMHEHGLGVNRDFHLAKRYYDQVSEHDHRFYLASKLSVKLHLKSWLT
WITREKVNYWKPSSPLNPNEDTQHSKTSWYKQLTKILQRMRHKEDSDKAAEDSHKHRTVV
QNGANHRGDDQEEASEILGFQMEDLVTMGCILGIFLLSILMSTLAARRGWNVRFNGAQLNA
NGNRQQEQQQQQAQGPPGWDFNVQIFAI
(SEQ ID NO: 1091)

>gi|6912348|ref|NP_036284.1|lysophosphatidic acid receptor 3 {Homo sapiens}
MNECHYDKHMDFFYNRSNTDTVDDWTGTKLVIVLCVGTFFCLFIFFSNSLVIAAVIKNRKFH
FPFYYLLANLAAADFFAGIAYVFLMFNTGPVSKTLTVNRWFLRQGLLDSSLTASLTNLLVIAV
ERHMSIMRMRVHSNLTKKRVTLLILLVWAIAIFMGAVPTLGWNCLCNISACSSLAPIYSRSYL
VFWTVSNLMAFLIMVVVYLRIYVYVKRKTNVLSPHTSGSISRRRTPMKLMKTVMTVLGAFV
VCWTPGLVVLLLDGLNCRQCGVQHVKRWFLLLALLNSVVNPIIYSYKDEDMYGTMKKMIC
CFSQENPERRPSRIPSTVLSRSDTGSQYIEDSISQGAVCNKSTS
(SEQ ID NO: 1092)

>gi|6912464|ref|NP_036434.1|latrophilin-2 precursor {Homo sapiens}
MVSSGCRMRSLWFIIVISFLPNTEGFSRAALPFGLVRRELSCEGYSIDLRCPGSDVIMIESANYG
RTDDKICDADPFQMENTDCYLPDAFKIMTQRCNNRTQCIVVTGSDVFPDPCPGTYKYLEVQY
ECVPYIFVCPGTLKAIVDSPCIYEAEQKAGAWCKDPLQAADKIYFMPWTPYRTDTLIEYASLE
DFQNSRQTTTYKLPNRVDGTGFVVYDGAVFFNKERTNIVKFDLRTRIKSGEAIINYANYHD
TSPYRWGGKTDIDLAVDENGLWVIYATEQNNGMIVISQLNPYTLRFEATWETVYDKRAASN TABLE 4-continued Targets from which the Analogs are derived

```
AFMICGVLYVVRSVYQDNESETGKNSIDYIYNTRLNRGEYVDVPFPNQYQYIAAVDYNPRD
NQLYVWNNNFILRYSLEFGPPDPAQVPTTAVTITSSAELFKTIISTTSTTSQKGPMSTTVAGSQ
EGSKGTKPPPAVSTTKIPPITNIFPLPERFCEALDSKGIKWPQTQRGMMVERPCPKGTRGTASY
LCMISTGTWNPKGPDLSNCTSHWVNQLAQKIRSGENAASLANELAKHTKGPVFAGDVSSSV
RLMEQLVDILDAQLQELKPSEKDSAGRSYNKAIVDTVDNLLRPEALESWKHMNSSEQAHTA
TMLLDTLEEGAFVLADNLLEPTRVSMPTENIVLEVAVLSTEGQIQDFKFPLGIKGAGSSIQLSA
NTVKQNSRNGLAKLVFIIYRSLGQFLSTENATIKLGADFIGRNSTIAVNSHVISVSINKESSRVY
LTDPVLFTLPHIDADNYFNANCSFWNYSERTMMGYWSTQGCKLVDTNKTRTTCACSHLTNF
AILMAHREIAYKDGVHELLLTVITWVGIVISLVCLAICIFTFCFFRGLQSDRNTIHKNLCINLFIA
EPIFLIGIDKTKYAIACPIFAGLLHFFFLAAFAWMCLEGVQLYLMLVEVFESEYSRKKYYVA
GYLFPATVVGVSAAIDYKSYGTEKACWLHVDNYFIWSFIGPVTFIILLNIIFLVITLCKMVKHS
NTLKPDSSRLENIKSWVLGAFALLCLLGLTWSFGLLFINEETIVMAYLFTIFNAFQGVFIFIFHC
ALQKKVRKEYGKCFRHSYCCGGLPTESPHSSVKASTTRTSARYSSGTQSRIRRMWNDTVRK
QSESSFISGDINSTSTLNQGHSLNNARDTSAMDTLPLNGNFNNSYSLHKGDYNDSVQVVDCG
LSLNDTAFEKMIISELVHNNLRGSSKTHNLELTLPVKPVIGGSSSEDDAIVADASSLMHSDNPG
LELHHKELEAPLIPQRTHSLLYQPQKKVKSEGTDSYVSQLTAEAEDHLQSPNRDSLYTSMPNL
RDSPYPESSPDMEEDLSPSRRSENEDIYYKSMPNLGAGHQLQMCYQISRGNSDGYIIPINKEGC
IPEGDVREGQMQLVTSL
(SEQ ID NO: 1093)

>gi|6912538|ref|NP_036476.1|neurotensin receptor type 2 {Homo sapiens}
METSSPRPPRPSSNPGLSLDARLGVDTRLWAKVLFTALYALIWALGAAGNALSVHVVLKAR
AGRAGRLRHHVLSLALAGLLLLLVGVPVELYSFVWFHYPWVFGDLGCRGYYFVHELCAYA
TVLSVAGLSAERCLAVCQPLRARSLLTPRRTRWLVALSWAASLGLALPMAVIMGQKHELET
ADGEPEPASRVCTVLVSRTALQVFIQVNVLVSFVLPLALTAFLNGVTVSHLLALCSQVPSTST
PGSSTPSRLELLSEEGLLSFIVWKKTFIQGGQVSLVRHKDVRRIRSLQRSVQVLRAIVVMYVIC
WLPYHARRLMYCYVPDDAWTDPLYNFYHYFYMVTNTLFYVSSAVTPLLYNAVSSSFRKLFL
EAVSSLCGEHHPMKRLPPKPQSPTLMDTASGFGDPPETRT
(SEQ ID NO: 1094)

>gi|7019387|ref|NP_037477.1|probable G-protein coupled receptor 132 {Homo sapiens}
MCPMLLKNGYNGNATPVTTTAPWASLGLSAKTCNNVSFEESRIVLVVVYSAVCTLGVPANC
LTAWLALLQVLQGNVLAVYLLCLALCELLYTGTLPLWVIYIRNQHRWTLGLLACKVTAYIFF
CNIYVSILFLCCISCDRFVAVVYALESRGRRRRRTAILISACIFILVGIVHYPVFQTEDKETCFD
MLQMDSRIAGYYYARFTVGFAIPLSIIAFTNHRIFRSIKQSMGLSAAQKAKVKHSAIAVVVIFL
VCFAPYHLVLLVKAAAFSYYRGDRNAMCGLEERLYTASVVFLCLSTVNGVADPIIYVLATD
HSRQEVSRIHKGWKEWSMKTDVTRLTHSRDTEELQSPVALADHYTFSRPVHPPGSPCPAKRL
IEESC
(SEQ ID NO: 1095)

>gi|7108336|ref|NP_036257.1|cholinergic receptor, muscarinic 5 {Homo sapiens}
MEGDSYHNATTVNGTPVNHQPLERHRLWEVITIAAVTAVVSLITIVGNVLVMISFKVNSQLK
TVNNYYLLSLACADLIIGIFSMNLYTTYILMGRWALGSLACDLWLALDYVASNASVMNLLVI
SFDRYFSITRPLTYRAKRTPKRAGIMIGLAWLISFILWAPAILCWQYLVGKRTVPLDECQIQFL
SEPTITFGTAIAAFYIPVSVMTILYCRIYRETEKRTKDLADLQGSDSVTKAEKRKPAHRALFRS
CLRCPRPTLAQRERNQASWSSSRRSTSTTGKPSQATGPSANWAKAEQLTTCSSYPSSEDEDKP
ATDPVLQVVYKSQGKESPGEEFSAEETEETFVKAETEKSDYDTPNYLLSPAAAHRPKSQKCV
AYKFRLVVKADGNQETNNGCHKVKIMPCPFPVAKEPSTKGLNPNPSHQMTKRKRVVLVKE
RKAAQTLSAILLAFIITWTPYNIMVLVSTFCDKCVPVTLWHLGYWLCYVNSTVNPICYALCN
RTFRKTFKMLLLCRWKKKKVEEKLYWQGNSKLP
(SEQ ID NO: 1096)

>gi|7305013|ref|NP_004711.2|lysophosphatidic acid receptor 2 {Homo sapiens}
MVIMGQCYYNETIGFFYNNSGKELSSHWRPKDVVVVALGLTVSVLVLLTNLLVIAAIASNRR
FHQPIYYLLGNLAAADLFAGVAYLFLMFHTGPRTARLSLEGWFIQGLLDTSLTASVATLLA
IAVERNRSVMAVQLHSRLPRGRVVMLIVGVWVAALGLGLLPAHSWHCLCALDRCSRMAPL
LSRSYLAVWALSSLLVFLLMVAVYTRIFFYVRRRVQRMAEHVSCHPRYRETTLSLVKTVVIIL
GAFVVCWTPGQVVLLLDGLGCESCNVLAVEKYFLLLAEANSLVNAAVYSCRDAEMRRTFR
RLLCCACLRQSTRESVHYTSSAQGGASTRIMLPENGHPLMDSTL
(SEQ ID NO: 1097)

>gi|7657136|ref|NP_055188.1|probable G-protein coupled receptor 160 {Homo sapiens}
MTALSSENCSFQYQLRQTNQPLDVNYLLFLIILGKILLNILTLGMRRKNTCQNFMEYFCISLAF
VDLLLLVNISIILYFRDFVLLSIRFTKYHICLFTQIISFTYGFLHYPVFLTACIDYCLNFSKTTKLS
FKCQKLFYFFTVILIWISVLAYVLGDPAIYQSLKAQNAYSRHCPFYVSIQSYWLSFPMVMILFV
AFITCWEEVTTLVQAIRITSYMNETILYFPFSSHSSYTVRSKKIFLSKLIVCFLSTWLPFVLLQVI
IVLLKVQIPAYIEMNIPWLYFVNSFLIATVYWFNCHKLNLKDIGLPLDPFVNWKCCFIPLTIPN
LEQIEKPISIMIC
(SEQ ID NO: 1098)

>gi|7669548|ref|NP_001050.1|tachykinin receptor 3 {Homo sapiens}
MATLPAAETWIDGGGVGADAVNLTASLAAGAATGAVETGWLQLLDQAGNLSSSPSALGL
PVASPAPSQPWANLTNQFVQPSWRIALWSLAYGVVVAVAVLGNLIVIWIILAHKRMRTVTN
YFLVNLAFSDASMAAFNTLVNFIYALHSEWYFGANYCRFQNFFPITAVFASIYSMTAIAVDRY
MAIIDPLKPRLSATATKIVIGSIWILAFLLAFPQCLYSKTKVMPGRTLCFVQWPEGPKQHFTYH
IIVIILVYCFPLLIMGITYTIVGITLWGGEIPGDTCDKYHEQLKAKRKVVKMMIIVVMTFAICW
```

TABLE 4-continued

Targets from which the Analogs are derived

```
LPYHIYFILTAIYQQLNRWKYIQQVYLASFWLAMSSTMYNPIIYCCLNKRFRAGFKRAFRWC
PFIKVSSYDELELKTTRFHPNRQSSMYTVTRMESMTVVFDPNDADTTRSSRKKRATPRDPSFN
GCSRRNSKSASATSSFISSPYTSVDEYS
(SEQ ID NO: 1099)

>gi|7706103|ref|NP_057652.1|relaxin/insulin-like family peptide receptor 3 {Homo sapiens}
MQMADAATIATMNKAAGGDKLAELFSLVPDLLEAANTSGNASLQLPDLWWELGLELPDGA
PPGHPPGSGGAESADTEARVRILISVVYWVVCALGLAGNLLVLYLMKSMQGWRKSSINLFV
TNLALTDFQFVLTLPFWAVENALDFKWPFGKAMCKIVSMVTSMNMYASVFFLTAMSVTRY
HSVASALKSHRTRGHGRGDCCGRSLGDSCCFSAKALCVWIWALAALASLPSAIFSTTVKM
GEELCLVRFPDKLLGRDRQFWLGLYHSQKVLLGFVLPLGIIILCYLLLVRFIADRRAAGTKGG
AAVAGGRPTGASARRLSKVTKSVTIVVLSFFLCWLPNQALTTWSILIKFNAVPFSQEYFLCQV
YAFPVSVCLAHSNSCLNPVLYCLVRREFRKALKSLLWRIASPSITSMRPFTATTKPEHEDQGL
QAPAPPHAAAEPDLLYYPPGVVVYSGGRYDLLPSSSAY
(SEQ ID NO: 1100)

>gi|7706451|ref|NP_057319.1|G-protein coupled receptor family C group 5 member B precursor
{Homo sapiens}
MFVASERKMRAHQVLTFLLLFVITSVASENASTSRGCGLDLLPQYVSLCDLDAIWGIVVEAV
AGAGALITLLLMLILLVRLPFIKEKEKKSPVGLHFLFLLGTLGLFGLTFAFIIQEDETICSVRRFL
WGVLFALCFSCLLSQAWRVRRLVRHGTGPAGWQLVGLALCLMLVQVIIAVEWLVLTVLRD
TRPACAYEPMDFVMALIYDMVLLVVTLGLALFTLCGKFKRWKLNGAFLLITAFLSVLIWVA
WMTMYLFGNVKLQQGDAWNDPTLAITLAASGWVFVIFHAIPEIHCTLLPALQENTPNYFDTS
QPRMRETAFEEDVQLPRAYMENKAFSMDEHNAALRTAGFPNGSLGKRPSGSLGKRPSAPFR
SNVYQPTEMAVVLNGGTIPTAPPSHTGRHLW
(SEQ ID NO: 1101)

>gi|8923705|ref|NP_061124.1|G-protein coupled receptor family C group 5 member D {Homo
sapiens}
MYKDCIESTGDYFLLCDAEGPWGIILESLAILGIVVTILLLLAFLFLMRKIQDCSQWNVLPTQL
LFLLSVLGLFGLAFAFIIELNQQTAPVRYFLFGVLFALCFSCLLAHASNLVKLVRGCVSFSWTT
ILCIAIGCSLLQIIATEYVTLIMTRGMMFVNMTPCQLNVDFVVLLVYVLFLMALTFFVSKATF
CGPCENWKQHGRLIFITVLFSIIWVVWISMLLRGNPQFQRQPQWDDPVVCIALVTNAWVFLL
LYIVPELCILYRSCRQECPLQGNACPVTAYQHSFQVENQELSRARDSDGAEEDVALTSYGTPI
QPQTVDPTQECFIPQAKLSPQQDAGGV
(SEQ ID NO: 1102)

>gi|8923873|ref|NP_060955.1|G protein-coupled receptor 77 {Homo sapiens}
MGNDSVSYEYGDYSDLSDRPVDCLDGACLAIDPLRVAPLPLYAAIFLVGVGPNAMVAWVA
GKVARRRVGATWLLHLAVADLLCCLSLPILAVPIARGGHWPYGAVGCRALPSIILLTMYASV
LLLAALSADLCFLALGPAWWSTVQRACGVQVACGAAWTLALLLTVPSAIYRRLHQEHFPAR
LQCVVDYGGSSSTENAVTAIRFLFGFLGPLVAVASCHSALLCWAARRCRPLGTAIVVGFFVC
WAPYHLLGLVLTVAAPNSALLARALRAEPLIVGLALAHSCLNPMLFLYFGRAQLRRSLPAAC
HWALRESQGQDESVDSKKSTSHDLVSEMEV
(SEQ ID NO: 1103)

>gi|9506745|ref|NP_061822.1|urotensin 2 receptor {Homo sapiens}
MALTPESPSSFPGLAATGSSVPEPPGGPNATLNSSWASPTEPSSLEDLVATGTIGTLLSAMGVV
GVVGNAYTLVVTCRSLRAVASMYVYVVNLALADLLYLLSIPFIVATYVTKEWHFGDVGCRV
LFGLDFLTMHASIFTLTTVMSSERYAAVLRPLDTVQRPKGYRKLLALGTWLLALLLTLPVMLA
MRLVRRGPKSLCLPAWGPRAHRAYLTLLFATSIAGPGLLIGLLYARLARAYRRSQRASFKRA
RRPGARALRLVLGIVLLFWACFLPFWLQLLAQYHQAPLAPRTARIVNYLTTCLTYGNSCA
NPFLYTLLTRNYRDHLRGRVRGPGSGGGRGPVPSLQPRARFQRCSGRSLSSCSPQPTDSLVLA
PAAPARPAPEGPRAPA
(SEQ ID NO: 1104)

>gi|9506747|ref|NP_061844.1|G protein-coupled receptor 27 {Homo sapiens}
MANASEPGGSGGGEAAALGLKLATLSLLLCVSLAGNVLFALLIVRERSLHRAPYYLLLDLCL
ADGLRALACLPAVMLAARRAAAAAGAPPGALGCKLLAFLAALFCFHAAFLLLGVGVTRYL
AIAHHRFYAERLAGWPCAAMLVCAAWALALAAAFPPVLDGGGDDEDAPCALEQRPDGAPG
ALGFLLLLAVVVGATHLVYLRLLFFIHDRRKMRPARLVPAVSHDWTFHGPGATGQAANW
TAGFGRGPTPPALVGIRPAGPGRGARRLLVLEEFKTEKRLCKMFYAVTLLFLLLWGPYVVAS
YLRVLVRPGAVPQAYLTASVWLTFAQAGINPVVCFLFNRELRDCFRAQFPCCQSPRTTQATH
PCDLKGIGL
(SEQ ID NO: 1105)

>gi|9507143|ref|NP_061842.1|probable G-protein coupled receptor 173 {Homo sapiens}
MANTTGEPEEVSGALSPPSASAYVKLVLLGLIMCVSLAGNAILSLLVLKERALHKAPYYFLL
DLCLADGIRSAVCFPFVLASVRHGSSWTFSALSCKIVAFMAVLFCPHAAFMLFCISVTRYMAI
AHHRFYAKRMTLWTCAAVICMAWTLSVAMAFPPVFDVGTYKFIREEDQCIFEHRYFKANDT
LGFMLMLAVLMAATHAVYGKLLLFEYRHRKMKPVQMVPAISQNWTFHGPGATGQAAN
WIAGFGRGPMPPTLLGIRQNGHAASRRLLGMDEVKGEKQLGRMFYAITLLFLLLWSPYIVAC
YWRVFVKACAVPHRYLATAVWMSFAQAAVNPIVCFLLNKDLKKCLRTHAPCWGTGGAPA
PREPYCVM
(SEQ ID NO: 1106)
```

TABLE 4-continued

Targets from which the Analogs are derived

>gi|9627743|ref|NP_054030.1|protein tyrosine phosphatase {Autographa californica
nucleopolyhedrovirus}
MFPARWHNYLQCGQVIKDSNLICFKTPLRPELFAYVTSEEDVWTAEQIVKQNPSIGAIIDLTN
TSKYYDGVHFLRAGLLYKKIQVPGQTLPPESIVQEFIDTVKEFTEKCPGMLVGVHCTHGINRT
GYMVCRYLMHTLGIAPQEAIDRFEKARGHKIERQNYVQDLLI
(SEQ ID NO: 1107)

>gi|9951913|ref|NP_062832.1|probable G-protein coupled receptor 162 isoform 2 {Homo sapiens}
MARGGAGAEEASLRSNALSWLACGLLALLANAWIILSISAKQQKHKPLELLLCFLAGTHILM
AAVPLTTFAVVQLRRQASSDYDWNESICKVFVSTYYTLALATCFTVASLSYHRMWMVRWP
VNYRLSNAKKQALHAVMGIWMVSFILSTLPSIGWHNNGERYYARGCQFIVSKIGLGFGVCFS
LLLLGGIVMGLVCVAITFYQTLWARPRRARQARRVGGGGGTKAGGPGALGTRPAFEVPAIV
VEDARGKRRSSLDGSESAKTSLQVTNLVSAIVFLYDSLTGVPILVVSFFSLKSDSAPPWMVLA
VLWCSMAQTLLLPSFIWSCERYRADVRTVWEQCVAIMSEEDGDDDGGCDDYAEGRVCKVR
FDANGATGPGSRDPAQVKLLPGRHMLFPPLERVHYLQVPLSRRLSHDETNIFSTPREPGSFLH
KWSSSDDIRVLPAQSRALGGPPEYLGQRHRLEDEEDEEEAEGGGLASLRQFLESGVLGSGGG
PPRGPGFFREEITTFIDETPLPSPTASPGHSPRRPRPLGLSPRRLSLGSPESRAVGLPLGLSAGRR
CSLTGGEESARAWGGSWGPGNPIFPQLTL
(SEQ ID NO: 1108)

>gi|9966839|ref|NP_065103.1|G protein-coupled receptor 84 {Homo sapiens}
MWNSSDANFSCYHESVLGYRYVAVSWGVVVAVTGTVGNVLTLLALAIQPKLRTRFNLLIAN
LTLADLLYCTLLQPFSVDTYLHLHWRTGATFCRVFGLLLFASNSVSILTLCLIALGRYLLIAHP
KLFPQVVFSAKGIVLALVSTWVVGVASFAPLWPIYILVPVVCTCSFDRIRGRPYTTILMGIYFVL
GLSSVGIFYCLIHRQVKRAAQALDQYKLRQASIHSNHVARTDEAMPGRFQELDSRLASGGPS
EGISSEPVSAATTQTLEGDSSEVGDQINSKRAKQMAEKSPPEASAKAQPIKGARRAPDSSSEF
GKVTRMCFAVFLCFALSYIPFLLLNILDARVQAPRVVHMLAANLTWLNGCINPVLYAAMNR
QFRQAYGSILKRGPRSFHRLH
(SEQ ID NO: 1109)

>gi|9966851|ref|NP_065110.1|cysteinyl leukotriene receptor 2 {Homo sapiens}
MERKFMSLQPSISVSEMEPNGTFSNNNSRNCTIENFKREFFPIVYLIIFFWGVLGNGLSIYVFLQ
PYKKSTSVNVFMLNLAISDLLFISTLPFRADYYLRGSNWIFGDLACRIMSYSLYVNMYSSIYFL
TVLSVVRFLAMVHPFRLLHVTSIRSAWILCGIIWILIMASSIMLLDSGSEQNGSVTSCLELNLY
KIAKLQTMNYIALVVGCLLPFFTLSICYLLIIRVLLKVEVPESGLRVSHRKALTTIIITLIIFFLCF
LPYHTLRTVHLTTWKVGLCKDRLHKALVITLALAAANACFNPLLYYFAGENFKDRLKSALR
KGHPQKAKTKCVFPVSVWLRKETRV
(SEQ ID NO: 1110)

>gi|9966879|ref|NP_065133.1|lysophosphatidic acid receptor 5 {Homo sapiens}
MLANSSSTNSSVLPCPDYRPTHRLHLVVYSLVLAAGLPLNALALWVFLRALRVHSVVSVYM
CNLAASDLLFTLSLPVRLSYYALHHWPFPDLLCQTTGAIFQMNMYGSCIFLMLINVDRYAAI
VHPLRLRHLRRPRVARLLCLGVWALILVFAVPAARVHRPSRCRYRDLEVRLCFESFSDELWK
GRLLPLVLLAEALGFLLPLAAVVYSSGRVFWTLARPDATQSQRRRKTVRLLLANLVIFLLCF
VPYNSTLAVYGLLRSKLVAASVPARDRVRGVLMVMVLLAGANCVLDPLVYYFSAEGFRNT
LRGLGTPHRARTSATNGTRAALAQSERSAVTTDATRPDAASQGLLRPSDSHSLSSFTQCPQDS
AL
(SEQ ID NO: 1111)

>gi|10092633|ref|NP_055314.1|putative P2Y purinoceptor 10 {Homo sapiens}
MANLDKYTETFKMGSNSTSTAEIYCNVTNVKFQYSLYATTYILIFIPGLLANSAALWVLCRFI
SKKNKAIIFMINLSVADLAHVLSLPLRIYYYISHHWPFQRALCLLCFYLKYLNMYASICFLTCI
SLQRCFFLLKPFRARDWKRRYDVGISAAIWIVVGTACLPFPILRSTDLNNNKSCFADLGYKQ
MNAVALVGMITVAELAGFVIPVIIAWCTWKTTISLRQPPMAFQGISERQKALRMVFMCAAV
FFICFTPYHINFIFYTMVKETIISSCPVVRIALYFHPFCLCLASLCCLLDPILYYFMASEFRDQLS
RHGSSVTRSRLMSKESGSSMIG
(SEQ ID NO: 1112)

>gi|10835015|ref|NP_001461.1|gamma-aminobutyric acid (GABA) B receptor 1 isoform a precursor
{Homo sapiens}
MLLLLLLAPLFLRPPGAGGAQTPNATSEGCQIIHPPWEGGIRYRGLTRDQVKAINFLPVDYEIE
YVCRGEREVVGPKVRKCLANGSWTDMDTPSRCVRICSKSYLTLENGKVFLTGGDLPALDGA
RVDFRCDPDFHLVGSSRSICSQGQWSTPKPHCQVNRTPHSERRAVYIGALFPMSGGWPGGQA
CQPAVEMALEDVNSRRDILPDYELKLIHHDSKCDPGQATKYLTYLNLYNDPIKIILMPGCSSVS
TLVAEAARMWNLIVLSYGSSSPALSNRQRFPTFFRTHPSATLHNPTRVKLFEKWGWKKIATI
QQTTEVFTSTLDDLEERVKEAGIEITFRQSFFSDPAVPVKNLKRQDARIIVGLFYETEARKVFC
EVYKERLFGKKYVWELIGWYADNWFKIYDPSINCTVDEMTEAVEGHITTEIVMLNPANTRSI
SNMTSQEFVEKLTKRLKRHPEETGGFQEAPLAYDAIWALALALNKTSGGGGRSGVRLEDFN
YNNQTITDQIYRAMNSSSFEGVSGHVVFDASGSRMAWTLIEQLQGGSYKKIGYYDSTKDDLS
WSKTDKWIGGSPPADQTLVIKTFRFLSQKLFISVSVLSSLGIVLAVVCLSFNIYNSHVRYIQNS
QPNLNNLTAVGCSLALAAVFPLGLDGYHIGRNQFPFVCQARLWLLGLGFSLGYGSMFTKIW
WVHTVFTKKEEKKEWRKTLEPWKLYATVGLLVGMDVLTLAIWQIVDPLHRTIETFAKEEPK
EDIDVSILPQLEHCSSRKMNTWLGIFYGYKGLLLLLGIFLAYETKSVSTEKINDHRAVGMAIY
NVAVLCLITAPVTMILSSQQDAAFAFASLAIVFSSYITLVVLFVPKMRRLITRGEWQSEAQDT
MKTGSSTNNNEEEKSRLLEKENRELEKIIAEKEERVSELRHQLQSRQQLRSRRHPPTPPEPSGG
LPRGPPEPPDRLSCDGSRVHLLYK
(SEQ ID NO: 1113)

TABLE 4-continued

Targets from which the Analogs are derived

>gi|10835175|ref|NP_000612.1|5-hydroxytryptamine receptor 2A isoform 1 {Homo sapiens}
MDILCEENTSLSSTTNSLMQLNDDTRLYSNDFNSGEANTSDAFNWTVDSENRTNLSCEGCLS
PSCLSLLHLQEKNWSALLTAVVIILTIAGNILVIMAVSLEKKLQNATNYFLMSLAIADMLLGF
LVMPVSMLTILYGYRWPLPSKLCAVWIYLDVLFSTASIMHLCAISLDRYVAIQNPIHHSRFNS
RTKAFLKIIAVWTISVGISMPIPVFGLQDDSKVFKEGSCLLADDNFVLIGSFVSFFIPLTIMVITY
FLTIKSLQKEATLCVSDLGTRAKLASFSFLPQSSLSSEKLFQRSIHREPGSYTGRRTMQSISNEQ
KACKVLGIVFFLFVVMWCPFFITNIMAVICKESCNEDVIGALLNVFVWIGYLSSAVNPLVYTL
FNKTYRSAFSRYIQCQYKENKKPLQLILVNTIPALAYKSSQLQMGQKKNSKQDAKTTDNDCS
MVALGKQHSEEASKDNSDGVNEKVSCV
(SEQ ID NO: 1114)

>gi|10835197|ref|NP_000857.1|5-hydroxytryptamine receptor 1F {Homo sapiens}
MDFLNSSDQNLTSEELLNRMPSKILVSLTLSGLALMTTTINSLVIAAIIVTRKLHHPANYLICSL
AVTDFLVAVLVMPFSIVYIVRESWIMGQVVCDIWLSVDITCCTCSILHLSAIALDRYRAITDAV
EYARKRTPKHAGIMITIVWIISVFISMPPLFWRHQGTSRDDECIIKHDHIVSTIYSTFGAFYIPLA
LILILYYKIYRAAKTLYHKRQASRIAKEEVNGQVLLESGEKSTKSVSTSYVLEKSLSDPSTDFD
KIHSTVRSLRSEFKHEKSWRRQKISGTRERKAATTLGLILGAFVICWLPFFVKELVVNVCDKC
KISEEMSNFLAWLGYLNSLINALIYTIFNEDFKKAFQKLVRCRC
(SEQ ID NO: 1115)

>gi|11321563|ref|NP_000861.1|5-hydroxytryptamine receptor 4 isoform b {Homo sapiens}
MDKLDANVSSEEGFGSVEKVVLLTFLSTVILMAILGNLLVMVAVCWDRQLRKIKTNYFIVSL
AFADLLVSVLVMPFGAIELVQDIWIYGEVFCLVRTSLDVLLTTASIFHLCCISLDRYYAICCQP
LVYRNKMTPLRIALMLGGCWVIPTFISFLPIMQGWNNIGIIDLIEKRKFNQNSNSTYCVFMVN
KPYAITCSVVAFYIPFLLMVLAYYRIYVTAKEHAHQIQMLQRAGASSESRPQSADQHSTHRM
RTETKAAKTLCIIMGCFCLCWAPFFVTNIVDPFIDYTVPGQVWTAFLWLGYINSGLNPFLYAF
LNKSFRRAFLIILCCDDERYRRPSILGQTVPCSTTTINGSTHVLRDAVECGGQWESQCHPPATS
PLVAAQPSDT
(SEQ ID NO: 1116)

>gi|11545887|ref|NP_071429.1|neuropeptide FF receptor 1 {Homo sapiens}
MEGEPSQPPNSSWPLSQNGTNTEATPATNLTFSSYYQHTSPVAAMFIVAYALIFLLCMVGNTL
VCFIVLKNRHMHTVTNMFILNLAVSDLLVGIFCMPTTLVDNLITGWPFDNATCKMSGLVQG
MSVSASVFTLVAIAVERFRCIVHPFREKLTLRKALVTIAVIWALALLIMCPSAVTLTVTREEHH
FMVDARNRSYPLYSCWEAWPEKGMRRVYTTVLFSHIYLAPLALIVVMYARIARKLCQAPGP
APGGEEAADPRASRRRARVVHMLVMVALFFTLSWLPLWALLLLIDYGQLSAPQLHLVTVYA
FPPAHWLAFFNSSANPIIYGYFNENFRRGFQAAFRARLCPRPSGSHKEAYSERPGGLLHRRVF
VVVRPSDSGLPSESGPSSGAPRPGRLPLRNGRVAHHGLPREGPGCSHLPLTIPAWDI
(SEQ ID NO: 1117)

>gi|12232483|ref|NP_073625.1|P2Y purinoceptor 12 {Homo sapiens}
MQAVDNLTSAPGNTSLCTRDYKITQVLFPLLYTVLFFVGLITNGLAMRIFFQIRSKSNFIIFLKN
TVISDLLMILTFPFKILSDAKLGTGPLRTFVCQVTSVIFYFTMYISISFLGLITIDRYQKTTRPFKT
SNPKNLLGAKILSVVIWAFMLLSLPNMILTNRQPRDKNVKKCSFLKSEFGLVWHEIVNYICQ
VIFWINFLIVIVCYTLITKELYRSYVRTRGVGKVPRKKVNVKVFIIIAVFFICFVPFHFARIPYTL
SQTRDVFDCTAENTLFYVKESTLWLTSLNACLDPFIYFFLCKSFRNSLISMLKCPNSATSLSQD
NRKKEQDGGDPNEETPM
(SEQ ID NO: 1118)

>gi|13027636|ref|NP_001391.2|sphingosine 1-phosphate receptor 1 {Homo sapiens}
MGPTSVPLVKAHRSSVSDYVNYDIIVRHYNYTGKLNISADKENSIKLTSVVFILICCFIILENIF
VLLTIWKTKFHRPMYYFIGNLALSDLLAGVAYTANLLLSGATTYKLTPAQWFLREGSMFV
ALSASVFSLLAIAIERYITMLKMKLHNGSNNFRLFLLISACWVISLILGGLPIMGWNCISALSSC
STVLPLYHKHYILFCTTVFTLLLLSIVILYCRIYSLVRTRSRRLTFRKNISKASRSSEKSLALLKT
VIIVLSVFIACWAPLFILLLLDVGCKVKTCDILFRAEYFLVLAVLNSGTNPIIYTLTNKEMRRAF
IRIMSCCKCPSGDSAGKFKRPIIAGMEFSRSKSDNSSHPQKDEGDNPETIMSSGNVNSSS
(SEQ ID NO: 1119)

>gi|13236497|ref|NP_076917.1|5-hydroxytryptamine receptor 5A {Homo sapiens}
MDLPVNLTSFSLSTPSPLETNHSLGKDDLRPSSPLLSVFGVLILTLLGFLVAATFAWNLLVAT
ILRVRTFHRVPHNLVASMAVSDVLVAALVMPLSLVHELSGRRWQLGRRLCQLWIACDVLCC
TASIWNVTAIALDRYWSITRHMEYTLRTRKCVSNVMIALTWALSAVISLAPLLFGWGETYSE
GSEECQVSREPSYAVFSTVGAFYLPLCVVLFVYWKIYKAAKFRVGSRKTNSVSPISEAVEVK
DSAKQPQMVFTVRHATVTFQPEGDTWREQKEQRAALMVGILIGVFVLCWIPFFLTELISPLCS
CDIPAIWKSIFLWLGYSNSFFNPLIYTAFNKNYNSAFKNFFSRQH
(SEQ ID NO: 1120)

>gi|13325064|ref|NP_001399.1|cadherin EGF LAG seven-pass G-type receptor 2 precursor {Homo sapiens}
MRSPATGVPLPTPPPPLLLLLLLLLPPPLLGDQVGPCRSLGSRGRGSSDACAPMGWLCPSSAS
NLWLYTSRCRDAGTELTGHLVPHHDGLRVWCPESEAHIPLPPAPEGCPWSCRLLGIGGHLSP
QGKLTLPEEHPCLKAPRLRCQSCKLAQAPGLRAGERSPEESLGGRRKRNVNTAPQFQPPSYQ
ATVPENQPAGTPVASLRAIDPDEGEAGRLEYTMDALFDSRSNQFFSLDPVTGAVTTAEELDR
ETKSTHVFRVTAQDHGMPRRSALATLTILVDTNDHDPVFEQQEYKESLRENLEVGYEVLTV
RATDGDAPPNANILYRLLEGSGGSPSEVFEIDPRSGVIRTRGPVDREEVESYQLTVEASDQGR
DPGPRSTTAAVFLSVEDDNDNAPQFSEKRYVVQVREDVTPGAPVLRVTASDRDKGSNAVVH
YSIMSGNARGQFYLDAQTGALDVVSPLDYETTKEYTLRVRAQDGGRPPLSNVSGLVTVQVL TABLE 4-continued Targets from which the Analogs are derived

```
DINDNAPIFVSTPFQATVLESVPLGYLVLHVQAIDADAGDNARLEYRLAGVGHDFPFTINNGT
GWISVAAELDREEVDFYSFGVEARDHGTPALTASASVSVTVLDVNDNNPTFTQPEYTVRLNE
DAAVGTSVVTVSAVDRDAHSVITYQITSGNTRNRFSITSQSGGGLVSLALPLDYKLERQYVL
AVTASDGTRQDTAQIVVNVTDANTHRPVFQSSHYTVNVNEDRPAGTTVVLISATDEDTGEN
ARITYFMEDSIPQFRIDADTGAVTTQAELDYEDQVSYTLAITARDNGIPQKSDTTYLEILVNDV
NDNAPQFLRDSYQGSVYEDVPPFTSVLQISATDRDSGLNGRVFYTFQGGDDGDGDFIVESTS
GIVRTLRRLDRENVAQYVLRAYAVDKGMPPARTPMEVTVTVLDVNDNPPVFEQDEFDVFVE
ENSPIGLAVARVTATDPDEGTNAQIMYQIVEGNIPEVFQLDIFSGELTALVDLDYEDRPEYVL
VIQATSAPLVSRATVHVRLLDRNDNPPVLGNFEILFNNYVTNRSSSFPGGAIGRVPAHDPDISD
SLTYSFERGNELSLVLLNASTGELKLSRALDNNRPLEAIMSVLVSDGVHSVTAQCALRVTIIT
DEMLTHSITLRLEDMSPERFLSPLLGLFIQAVAATLATPPDHVVVFNVQRDTDAPGGHILNVS
LSVGQPPGPGGGPPFLPSEDLQERLYLNRSLLTAISAQRVLPFDDNICLREPCENYMRCVSVLR
FDSSAPFIASSSVLFRPIHPVGGLRCRCPPGFTGDYCETEVDLCYSRPCGPHGRCRSREGGYTC
LCRDGYTGEHCEVSARSGRCTPGVCKNGGTCVNLLVGGFKCDCPSGDFEKPYCQVTTRSFP
AHSFITFRGLRQRFHFTLALSFATKERDGLLLLYNGRFNEKHDFVALEVIQEQVQLTFSAGEST
TTVSPFVPGGVSDGQWHTVQLKYYNKPLLGQTGLPQGPSEQKVAVVTVDGCDTGVALRFG
SVLGNYSCAAQGTQGGSKKSLDLTGPLLLGGVPDLPESFPVRMRQFVGCMRNLQVDSRHID
MADFIANNGTVPGCPAKKNVCDSNTCHNGGTCVNQWDAFSCECPLGFGGKSCAQEMANPQ
HFLGSSLVAWHGLSLPISQPWYLSLMFRTRQADGVLLQAITRGRSTITLQLREGHVMLSVEG
TGLQASSLRLEPGRANDGDWHHAQLALGASGGPGHAILSFDYGQQRAEGNLGPRLHGLHLS
NITVGGIPGPAGGVARGFRGCLQGVRVSDTPEGVNSLDPSHGESINVEQGCSLPDPCDSNPCP
ANSYCSNDWDSYSCSCDPGYYGDNCTNVCDLNPCEHQSVCTRKPSAPHGYTCECPPNYLGP
YCETRIDQPCPRGWWGHPTCGPCNCDVSKGFDPDCNKTSGECHCKENHYRPPGSPTCLLCD
CYPTGSLSRVCDPEDGQCPCKPGVIGRQCDRCDNPFAEVTTNGCEVNYDSCPRAIEAGIWWP
RTRFGLPAAAPCPKGSFGTAVRHCDEHRGWLPPNLFNCTSITFSELKGFAERLQRNESGLDSG
RSQQLALLLRNATQHTAGYFGSDVKVAYQLATRLLAHESTQRGFGLSATQDVHFTENLLRV
GSALLDTANKRHWELIQQTEGGTAWLLQHYEAYASALAQNMRHTYLSPFTIVTPNIVISVVR
LDKGNFAGAKLPRYEALRGEQPPDLETTVILPESVFRETPPVVRPAGPGEAQEPEELARRQRR
HPELSQGEAVASVIIYRTLAGLLPHNYDPDKRSLRVPKRPIINTPVVSISVHDDEELLPRALDK
PVTVQFRLLETEERTKPICVFWNHSILVSGTGGWSARGCEVVFRNESHVSCQCNHMTSFAVL
MDVSRRENGEILPLKTLTYVALGVTLAALLLTFFFLTLLRILRSNQNGIRRNLTAALGLAQLV
FLLGINQADLPFACTVIAILLHFLYLCTFSWALLEALHLYRALTEVRDVNTGPMRFYYMLGW
GVPAFITGLAVGLDPEGYGNPDFCWLSIYDTLIWSFAGPVAFAVSMSVFLYILAARASCAAQ
RQGFEKKGPVSGLQPSFAVLLLLSATWLLALLSVNSDTLLFHYLFATCNCIQGPFIFLSYVVLS
KEVRKALKLACSRKPSPDPALTTKSTLTSSYNCPSPYADGRLYQPYGDSAGSLHSTSRSGKSQ
PSYIPFLLREESALNPGQGPPGLGDPGSLFLEGQDQQHDPTDTDSDLSLEDDQSGSYASTHSS
DSEEEEEEEEEEAAFPGEQGWDSLLGPGAERLPLHSTPKDGGPGPGKAPWPGDFGTTAKESS
GNGAPEERLRENGDALSREGSLGPLPGSSAQPHKGILKKKCLPTISEKSSLLRLPLEQCTGSSR
GSSASEGSRGGPPPRPPPRQSLQEQLNGVMPIAMSIKAGTVDEDSSGSEFLFFNFLH
(SEQ ID NO: 1121)

>gi|13435405|ref|NP_071640.1|histamine H2 receptor isoform 2 {Homo sapiens}
MAPNGTASSFCLDSTACKITITVVLAVLILITVAGNVVVCLAVGLNRRLRNLTNCFIVSLAITD
LLLGLLVLPFSAIYQLSCKWSFGKVFCNIYTSLDVMLCTASILNLFMISLDRYCAVMDPLRYP
VLVTPVRVAISLVLIWVISITLSFLSIHLGWNSRNETSKGNHTTSKCKVQVNEVYGLVDGLVT
FYLPLLIMCITYYRIFKVARDQAKRINHISSWKAATIREHKATVTLAAVMGAFIICWFPYFTAF
VYRGLRGDDAINEVLEAIVLWLGYANSALNPILYAALNRDFRTGYQQLFCCRLANRNSHKTS
LRSNASQLSRTQSREPRQQEEKPLKLQVWSGTEVTAPQGATDR
(SEQ ID NO: 1122)

>gi|13540517|ref|NP_110387.1|endothelial differentiation, sphingolipid G-protein-coupled receptor,
8 {Homo sapiens}
MESGLLRPAPVSEVIVLHYNYTGKLRGARYQPGAGLRADAVVCLAVCAFIVLENLAVLLVL
GRHPRFHAPMFLLLGSLTLSDLLAGAAYAANILLSGPLTLKLSPALWFAREGGVFVALTASV
LSLLAIALERSLTMARRGPAPVSSRGRTLAMAAAAWGVSLLLGLLPALGWNCLGRLDACST
VLPLYAKAYVLFCVLAFVGILAAICALYARIYCQVRANARRLPARPGTAGTTSTRARRKPRS
LALLRTLSVVLLAFVACWGPLFLLLLLDVACPARTCPVLLQADPFLGLAMANSLLNPIIYTLT
NRDLRHALLRLVCCGRHSCGRDPSGSQQSASAAEASGGLRRCLPPGLDGSFSGSERSSPQRD
GLDTSGSTGSPGAPTAARTLVSEPAAD
(SEQ ID NO: 1123)

>gi|13540557|ref|NP_110411.1|probable G-protein coupled receptor 63 {Homo sapiens}
MVFSAVLTAFHTGTSNTTFVVYENTYMNITLPPPFQHPDLSPLLRYSFETMAPTGLSSLTVNS
TAVPTTPAAFKSLNLPLQITLSAIMIFILFVSFLGNLVVCLMVYQKAAMRSAINILLASLAFAD
MLLAVLNMPFALVTILTTRWIFGKFFCRVSAMFFWLFVIEGVAILLIISIDRFLITVQRQDKLNP
YRAKVLIAVSWATSFCVAFPLAVGNPDLQIPSRAPQCVFGYTTNPGYQAYVILISLISFFIPPLV
ILYSFMGILNTLRHNALRIHSYPEGICLSQASKLGLMSLQRPFQMSIDMGFKTRAFTTILILFAV
FIVCWAPFTTYSLVATFSKHFYYQHNFFEISTWLLWLCYLKSALNPLIYYWRIKKFHDACLD
MMPKSFKFLPQLPGHTKRRIRPSAVYVCGEHRTVV
(SEQ ID NO: 1124)

>gi|13929467|ref|NP_001287.2|chemokine-binding protein 2 {Homo sapiens}
MAATASPQPLATEDADSENSSFYYYDYLDEVAFMLCRKDAVVSFGKVFLPVFYSLIFVLGLS
GNLLLLMVLLRYVPRRRMVEIYLLNLAISNLLFLVTLPFWGISVAWHWVFGSFLCKMVSTLY
TINFYSGIFFISCMSLDKYLEIVHAQPYHRLRTRAKSLLLATIVWAVSLAVSIPDMVFVQTHEN
PKGVWNCHADFGGHGTIWKLFLRFQQNLLGFLLPLLAMIFFYSRIGCVLVRLRPAGQGRALK
```

TABLE 4-continued

Targets from which the Analogs are derived

IAAALVVAFFVLWFPYNLTLFLHTLLDLQVFGNCEVSQHLDYALQVTESIAFLHCCFSPILYA
FSSHRFRQYLKAFLAAVLGWHLAPGTAQASLSSCSESSILTAQEEMTGMNDLGERQSENYPN
KEDVGNKSA
(SEQ ID NO: 1125)

>gi|14043044|ref|NP_006632.2|C-C chemokine receptor type 9 isoform B {Homo sapiens}
MADDYGSESTSSMEDYVNFNFTDFYCEKNNVRQFASHFLPPLYWLVFIVGALGNSLVILVY
WYCTRVKTMTDMFLLNLAIADLLFLVTLPFWAIAAADQWKFQTFMCKVVNSMYKMNFYS
CVLLIMCISVDRYIAIAQAMRAHTWREKRLLYSKMVCFTIWVLAAALCIPEILYSQIKEESGIA
ICTMVYPSDESTKLKSAVLTLKVILGFFLPFVVMACCYTIIIHTLIQAKKSSKHKALKVTITVLT
VFVLSQFPYNCILLVQTIDAYAMFISNCAVSTNIDICFQVTQTIAFFHSCLNPVLYVFVGERFRR
DLVKTLKNLGCISQAQWVSFTRREGSLKLSSMLLETTSGALSL
(SEQ ID NO: 1126)

>gi|14211849|ref|NP_115942.1|probable G-protein coupled receptor 174 {Homo sapiens}
MPANYTCTRPDGDNTDFRYFIYAVTYTVILVPGLIGNILALWVFYGYMKETKRAVIFMINLAI
ADLLQVLSLPLRIFYYLNHDWPFGPGLCMFCFYLKYVNMYASIYFLVCISVRRFWFLMYPFR
FHDCKQKYDLYISIAGWLIICLACVLFPLLRTSDDTSGNRTKCFVDLPTRNVNLAQSVVMMTI
GELIGFVTPLLIVLYCTWKTVLSLQDKYPMAQDLGEKQKALKMILTCAGVFLICFAPYHFSFP
LDFLVKSNEIKSCLARRVILIFHSVALCLASLNSCLDPVIYYFSTNEFRRRLSRQDLHDSIQLHA
KSFVSNHTASTMTPELC
(SEQ ID NO: 1127)

>gi|14211851|ref|NP_115943.1|G-protein coupled receptor 81 {Homo sapiens}
MYNGSCCRIEGDTISQVMPPLLIVAFVLGALGNGVALCGFCFHMKTWKPSTVYLFNLAVAD
FLLMICLPFRTDYYLRRRHWAFGDIPCRVGLFTLAMNRAGSIVFLTVVAADRYFKVVHPHHA
VNTISTRVAAGIVCTLWALVILGTVYLLLENHLCVQETAVSCESFIMESANGWHDIMFQLEFF
MPLGIILFCSFKIVWSLRRRQQLARQARMKKATRFIMVVAIVFITCYLPSVSARLYFLWTVPSS
ACDPSVHGALHITLSFTYMNSMLDPLVYYFSSPSFPKFYNKLKICSLKPKQPGHSKTQRPEEM
PISNLGRRSCISVANSFQSQSDGQWDPHIVEWH
(SEQ ID NO: 1128)

>gi|14251205|ref|NP_067637.2|histamine H4 receptor isoform 1 {Homo sapiens}
MPDTNSTINLSLSTRVTLAFFMSLVAFAIMLGNALVILAFVVDKNLRHRSSYFFLNLAISDFFV
GVISIPLYIPHTLFEWDFGKEICVFWLTTDYLLCTASVYNIVLISYDRYLSVSNAVSYRTQHTG
VLKIVTLMVAVWVLAFLVNGPMILVSESWKDEGSECEPGFFSEWYILAITSFLEFVIPVILVAY
FNMNIYWSLWKRDHLSRCQSHPGLTAVSSNICGHSFRGRLSSRRSLSASTEVPASFHSERQRR
KSSLMFSSRTKMNSNTIASKMGSFSQSDSVALHQREHVELLRARRLAKSLAILLGVFAVCWA
PYSLFTIVLSFYSSATGPKSVWYRIAFWLQWFNSFVNPLLYPLCHKRFQKAFLKIFCIKKQPLP
SQHSRSVSS
(SEQ ID NO: 1129)

>gi|14589869|ref|NP_116743.1|Burkitt lymphoma receptor 1 isoform 2 {Homo sapiens}
MASFKAVFVPVAYSLIFLLGVIGNVLVLVILERHRQTRSSTETFLFHLAVADLLLVFILPFAVA
EGSVGWVLGTFLCKTVIALHKVNFYCSSLLLACIAVDRYLAIVHAVHAYRHRRLLSIHITCGT
IWLVGFLLALPEILFAKVSQGHHNNSLPRCTFSQENQAETHAWFTSRFLYHVAGFLLPMLVM
GWCYVGVVHRLRQAQRRPQRQKAVRVAILVTSIFFLCWSPYHIVIFLDTLARLKAVDNTCKL
NGSLPVAITMCEFLGLAHCCLNPMLYTFAGVKFRSDLSRLLTKLGCTGPASLCQLFPSWRRSS
LSESENATSLTTF
(SEQ ID NO: 1130)

>gi|15029528|ref|NP_005283.1|N-arachidonyl glycine receptor {Homo sapiens}
MITLNNQDQPVPFNSSHPDEYKIAALVFYSCIFIIGLFVNITALWVFSCTTKKRTTVTIYMMNV
ALVDLIFIMTLPFRMFYYAKDEWPFGEYFCQILGALTVFYPSIALWLLAFISADRYMAIVQPK
YAKELKNTCKAVLACVGVWIMTLTTTTPLLLLYKDPDKDSTPATCLKISDIIYLKAVNVLNL
TRLTFFFLIPLFIMIGCYLVIIHNLLHGRTSKLKPKVKEKSIRIIITLLVQVLVCFMPFHICFAFLM
LGTGENSYNPWGAFTTFLMNLSTCLDVILYYIVSKQFQARVISVMLYRNYLRSMRRKSFRSG
SLRSLSNINSEML
(SEQ ID NO: 1131)

>gi|15619006|ref|NP_004615.2|vasoactive intestinal polypeptide receptor 1 precursor {Homo sapiens}
MRPPSPLPARWLCVLAGALAWALGPAGGQAARLQEECDYVQMIEVQHKQCLEEAQLENETI
GCSKMWDNLTCWPATPRGQVVVLACPLIFKLFSSIQGRNVSRSCTDEGWTHLEPGPYPIACG
LDDKAASLDEQQTMFYGSVKTGYTIGYGLSLATLLVATAILSLFRKLHCTRNYIHMHLFISFIL
RAAAVFIKDLALFDSGESDQCSEGSVGCKAAMVFFQYCVMANFFWLLVEGLYLYTLLAVSF
FSERKYFWGYILIGWGVPSTFTMVWTIARIHFEDYGCWDTINSSLWWIIKGPILTSILVNFILFI
CIIRILLQKLRPPDIRKSDSSPYSRLARSTLLLIPLFGVHYIMFAFFPDNFKPEVKMVFELVVGSF
QGFVVAILYCFLNGEVQAELRRKWRRWHLQGVLGWNPKYRHPSGGSNGATCSTQVSMLTR
VSPGARRSSSFQAEVSLV
(SEQ ID NO: 1132)

>gi|16418463|ref|NP_443199.1|MAS1 oncogene-like {Homo sapiens}
MVWGKICWFSQRAGWTVFAESQISLSCSLCLHSGDQEAQNPNLVSQLCGVFLQNETNETIH
MQMSMAVGQQALPLNIIAPKAVLSLCGVLLNGTVFWLLCCGATNPMVYILHLVAADVIY
LCCSAVGFLQVTLLTYHGVVFFIPDFLAILSPFSFEVCLCLLVAISTERCVCVLFPIWYRCHRPK
YTSNVVCTLIWGLPFCINIVKSLFLTYWKHVKACVIFLKLSGLFHAILSLVMCVSSLTLLIRFL TABLE 4-continued Targets from which the Analogs are derived CCSQQQKATRVYAVVQISAPMFLLWALPLSVAPLITDFKMFVTTSYLISLFLIINSSANPIIYFF
VGSLRKKRLKESLRVILQRALADKPEVGRNKKAAGIDPMEQPHSTQHVENLLPREHRVDVET
(SEQ ID NO: 1133)

>gi|16751917|ref|NP_444508.1|trace amine associated receptor 8 {Homo sapiens}
MTSNFSQPVVQLCYEDVNGSCIETPYSPGSRVILYTAFSFGSLLAVFGNLLVMTSVLHFKQLH
SPTNFLIASLACADFLVGVTVMLFSMVRTVESCWYFGAKFCTLHSCCDVAFCYSSVLHLCFIC
IDRYIVVTDPLVYATKFTVSVSGICISVSWILPLTYSGAVFYTGVNDDGLEELVSALNCVGGC
QIIVSQGWVLIDFLLFFIPTLVMIILYSKIFLIAKQQAIKIETTSSKVESSSESYKIRVAKRERKAA
KTLGVTVLAFVISWLPYTVDILIDAFMGFLTPAYIYEICCWSAYYNSAMNPLIYALFYPWFRK
AIKLILSGDVLKASSSTISLFLE
(SEQ ID NO: 1134)

>gi|16876435|ref|NP_473362.1|probable G-protein coupled receptor 101 {Homo sapiens}
MTSTCTNSTRESNSSHTCMPLSKMPISLAHGIIRSTVLVIFLAASFVGNIVLALVLQRKPQLLQ
VTNRFIFNLLVTDLLQISLVAPWVVATSVPLFWPLNSHFCTALVSLTHLFAFASVNTIVVVSV
DRYLSIIHPLSYPSKMTQRRGYLLLYGTWIVAILQSTPPLYGWGQAAFDERNALCSMIWGASP
SYTILSVVSFIVIPLIVMIACYSVVFCAARRQHALLYNVKRHSLEVRVKDCVENEDEEGAEKK
EEFQDESEFRRQHEGEVKAKEGRMEAKDGSLKAKEGSTGTSESSVEARGSEEVRESSTVASD
GSMEGKEGSTKVEENSMKADKGRTEVNQCSIDLGEDDMEFGEDDINFSEDDVEAVNIPESLP
PSRRNSNSNPPLPRCYQCKAAKVIFIIIFSYVLSLGPYCFLAVLAVWVDVETQVPQWVITIIIWL
FFLQCCIHPYVYGYMHKTIKKEIQDMLKKFFCKEKPPKEDSHPDLPGTEGGTEGKIVPSYDSA
TFP
(SEQ ID NO: 1135)

>gi|16950636|ref|NP_001392.2|lysophosphatidic acid receptor 1 {Homo sapiens}
MAAISTSIPVISQPQFTAMNEPQCFYNESIAFFYNRSGKHLATEWNTVSKLVMGLGITVCIFIM
LANLLVMVAIYVNRRFHFPIYYLMANLAAADFFAGLAYFYLMFNTGPNTRRLTVSTWLLRQ
GLIDTSLTASVANLLAIAIERHITVFRMQLHTRMSNRRVVVVIVVIWTMAIVMGAIPSVGWNC
ICDIENCSNMAPLYSDSYLVFWAIFNLVTFVVMVVLYAHIFGYVRQRTMRMSRHSSGPRRNR
DTMMSLLKTVVIVLGAPFIICWTPGLVLLLLDVCCPQCDVLAYEKFFLLLAEFNSAMNPIIYSY
RDKEMSATFRQILCCQRSENPTGPTEGSDRSASSLNHTILAGVHSNDHSVV
(SEQ ID NO: 1136)

>gi|17978491|ref|NP_510966.1|CD97 antigen isoform 1 precursor {Homo sapiens}
MGGRVFLAFCVWLTLPGAETQDSRGCARWCPQNSSCVNATACRCNPGFSSFSEIITTPTETCD
DINECATPSKVSCGKFSDCWNTEGSYDCVCSPGYEPVSGAKTFKNESENTCQDVDECQQNPR
LCKSYGTCVNTLGSYTCQCLPGFKFIPEDPKVCTDVNECTSGQNPCHSSTHCLNNVGSYQCR
CRPGWQPIPGSPNGPNNTVCEDVDECSSGQHQCDSSTVCFNTVGSYSCRCRPGWKPRHGIPN
NQKDTVCEDMTFSTWTPPPGVHSQTLSRFFDKVQDLGRDSKTSSAEVTIQNVIKLVDELMEA
PGDVEALAPPVRHLIATQLLSNLEDIMRILAKSLPKGPFTYISPSNTELTLMIQERGDKNVTMG
QSSARMKLNWAVAAGAEDPGPAVAGILSIQNMTTLLANASLNLHSKKQAELEEIYESSIRGV
QLRRLSAVNSIFLSHNNTKELNSPILFAFSHLESSDGEAGRDPPAKDVMPGPRQELLCAFWKS
DSDRGGHWATEGCQVLGSKNGSTTCQCSHLSSFAILMAHYDVEDWKLTLITRVGLALSLFC
LLLCILTFLLVRPIQGSRTTIHLHLCICLFVGSTIFLAGIENEGGQVGLRCRLVAGLLHYCFLAA
FCWMSLEGLELYFLVVRVFQGQGLSTRWLCLIGYGVPLLIVGVSAAIYSKGYGRPRYCWLDF
EQGFLWSFLGPVTFIILCNAVIFVTTVWKLTQKFSEINPDMKKLKKARALTITAIAQLFLLGCT
WVFGLFIFDDRSLVLTYVFTILNCLQGAFLYLLHCLLNKKVREEYRKWACLVAGGSKYSEFT
STTSGTGHNQTRALRASESGI
(SEQ ID NO: 1137)

>gi|18201870|ref|NP_543007.1|probable G-protein coupled receptor 82 {Homo sapiens}
MNNNTTCIQPSMISSMALPIIYILLCIVGVFGNTLSQWIFLTKIGKKTSTHIYLSHLVTANLLVC
SAMPFMSIYFLKGFQWEYQSAQCRVVNFLGTLSMHASMFVSLLILSWIAISRYATLMQKDSS
QETTSCYEKIFYGHLLKKFRQPNFARKLCIYIWGVVLGIIIPVTVYYSVIEATEGEESLCYNRQ
MELGAMISQIAGLIGTTFIGFSFLVVLTSYYSFVSHLRKIRTCTSIMEKDLTYSSVKRHLLVIQIL
LIVCFLPYSIFKPIFYVLHQRDNCQQLNYLIETKNILTCLASARSSTDPIIFLLLDKTFKKTLYNL
FTKSNSAHMQSYG
(SEQ ID NO: 1138)

>gi|18677729|ref|NP_570718.1|relaxin receptor 2 isoform 1 {Homo sapiens}
MIVFLVPFKHLFSLRLITMFFLLHFIVLINVKDFALTQGSMITPSCQKGYFPCGNLTKCLPRAFH
CDGKDDCGNGADEENCGDTSGWATIFGTVHGNANSVALTQECFLKQYPQCCDCKETELEC
VNGDLKSVPMISNNVTLLSLKKNKIHSLPDKVFIKYTKLKKIFLQHNCIRHISRKAFFGLCNLQ
ILYLNHNCITTLRPGIFKDLHQLTWLILDDNPITRISQRLFTGLNSLFFLSMVNNYLEALPKQM
CAQMPQLNWVDLEGNRIKYLTNSTFLSCDSLTVLFLPRNQIGFVPEKTFSSLKNLGELDLSSN
TITELSPHLFKDLKLLQKLNLSSNPLMYLHKNQFESLKQLQSLDLERIEIPNINTRMFQPMKNL
SHIYFKNFRYCSYAPHVRICMPLTDGISSFEDLLANNILRIFVWVIAFITCFGNLFVIGMRSFIKA
ENTTHAMSIKILCCADCLMGVYLFFVGIFDIKYRGQYQKYALLWMESVQCRLMGFLAMLST
EVSVLLLTYLTLEKFLVIVFPFSNIRPGKRQTSVILICIWMAGFLIAVIPFWNKDYFGNFYGKN
GVCFPLYYDQTEDIGSKGYSLGIFLGVNLLAFLIIVFSYITMFCSIQKTALQTTEVRNCFGREV
AVANRFFFIVFSDAICWIPVFVVKILSLFRVEIPDTMTSWIVIFFLPVNSALNPILYTLTTNFFKD
KLKQLLHKHQRKSIFKIKKKSLSTSIVWIEDSSSLKLGVLNKITLGDSIMKPVS
(SEQ ID NO: 1139)

>gi|19923245|ref|NP_004373.2|corticotropin-releasing factor receptor 1 isoform 2 {Homo sapiens}
MGGHPQLRLVKALLLLGLNPVSASLQDQHCESLSLASNISGLQCNASVDLIGTCWPRSPAGQ
LVVRPCPAFFYGVRYNTTNNGYRECLANGSWAARVNYSECQEILNEEKKSKVHYHVAVIIN TABLE 4-continued Targets from which the Analogs are derived YLGHCISLVALLVAFVLFLRLRSIRCLRNIIHWNLISAFILRNATWFVVQLTMSPEVHQSNVG
WCRLVTAAYNYFHVTNFFWMFGEGCYLHTAIVLTYSTDRLRKWMFICIGWGVPFPIIVAWAI
GKLYYDNEKCWFGKRPGVYTDYIYQGPMILVLLINFIFLFNIVRILMTKLRASTTSETIQYRKA
VKATLVLLPLLGITYMLFFVNPGEDEVSRVVFIYFNSFLESFQGFFVSVFYCFLNSEVRSAIRK
RWHRWQDKHSIRARVARAMSIPTSPTRVSFHSIKQSTAV
(SEQ ID NO: 1140)

>gi|19923975|ref|NP_612454.1|G protein-coupled receptor 146 {Homo sapiens}
MWSCSWFNGTGLVEELPACQDLQLGLSLLSLLGLVVGVPVGLCYNALLVLANLHSKASMT
MPDVYFVNMAVAGLVLSALAPVHLLGPPSSRWALWSVGGEVHVALQIPFNVSSLVAMYST
ALLSLDHYIERALPRTYMASVYNTRHVCGFVWGGALLTSFSSLLFYICSHVSTRALECAKMQ
NAEAADATLVFIGYVVPALATLYALVLLSRVRREDTPLDRDTGRLEPSAHRLLVATVCTQFG
LWTPHYLILLGHTVIISRGKPVDAHYLGLLHFVKDFSKLLAFSSSFVTPLLYRYMNQSFPSKL
QRLMKKLPCGDRHCSPDHMGVQQVLA
(SEQ ID NO: 1141)

>gi|20373179|ref|NP_620414.1|G protein-coupled receptor 73 {Homo sapiens}
METTMGFMDDNATNTSTSFLSVLNPHGAHATSFPFNFSYSDYDMPLDEDEDVTNSRTFFAA
KIVIGMALVGIMLVCGIGNFIFIAALVRYKKLRNLTNLLIANLAISDFLVAIVCCPFEMDYYVV
RQLSWEHGHVLCTSVNYLRTVSLYVSTNALLAIAIDRYLAIVHPLRPRMKCQTATGLIALVW
TVSILIAIPSAYFTTETVLVIVKSQEKIFCGQIWPVDQQLYYKSYFLFIFGIEFVGPVVTMTLCY
ARISRELWFKAVPGFQTEQIRKRLRCRRKTVLVLMCILTAYVLCWAPFYGFTIVRDFFPTVFV
KEKHYLTAFYIVECIAMSNSMINTLCFVTVKNDTVKYFKKIMLLHWKASYNGGKSSADLDL
KTIGMPATEEVDCIRLK
(SEQ ID NO: 1142)

>gi|20544172|ref|NP_000701.2|B1 bradykinin receptor {Homo sapiens}
MASSWPPLELQSSNQSQLFPQNATACDNAPEAWDLLHRVLPTFIISICFFGLLGNLFVLLVFLL
PRRQLNVAEIYLANLAASDLVFVLGLPFWAENIWNQFNWPFGALLCRVINGVIKANLFISIFL
VVAISQDRYRVLVHPMASRRQQRRRQARVTCVLIWVVGGLLSIPTFLLRSIQAVPDLNITACI
LLLPHEAWHFARIVELNILGFLLPLAAIVFFNYHILASLRTREEVSRTRCGGRKDSKTTALILTL
VVAFLVCWAPYHFFAFLEFLFQVQAVRGCFWEDFIDLGLQLANFFAFTNSSLNPVIYVFVGR
LFRTKVWELYKQCTPKSLAPISSSHRKEIFQLFWRN
(SEQ ID NO: 1143)

>gi|21264324|ref|NP_612200.1|trace amine associated receptor 1 {Homo sapiens}
MMPFCHNIINISCVKNNWSNDVRASLYSLMVLIILTTLVGNLIVIVSISHFKQLHTPTNWLIHS
MATVDFLLGCLVMPYSMVRSAEHCWYFGEVFCKIHTSTDIMLSSASIFHLSFISIDRYYAVCD
PLRYKAKMNILVICVMIFISWSVPAVFAFGMIFLELNFKGAEEIYYKHVHCRGGCSVFFSKISG
VLTFMTSFYIPGSIMLCVYYRIYLIAKEQARLISDANQKLQIGLEMKNGISQSKERKAVKTLGI
VMGVFLICWCPFFICTVMDPFLHYIIPPTLNDVLIWFGYLNSTFNPMVYAFFYPWFRKALKM
MLFGKIFQKDSSRCKLFLELSS
(SEQ ID NO: 1144)

>gi|21361557|ref|NP_003373.2|vasoactive intestinal polypeptide receptor 2 {Homo sapiens}
MRTLLPPALLTCWLLAPVNSIHPECRFHLEIQEEETKCAELLRSQTEKHKACSGVWDNITCW
RPANVGETVTVPCPKVFSNFYSKAGNISKNCTSDGWSETFPDFVDACGYSDPEDESKITFYIL
VKAIYTLGYSVSLMSLATGSIILCLFRKLHCTRNYIHLNLFLSFILRAISVLVKDDVLYSSSGTL
HCPDQPSSWVGCKLSLVFLQYCIMANFFWLLVEGLYLHTLLVAMLPPRRCFLAYLLIGWGLP
TVCIGAWTAARLYLEDTGCWDTNDHSVPWWVIRIPILISIIVNFVLFISIIRILLQKLTSPDVGG
NDQSQYKRLAKSTLLLIPLFGVHYMVFAVFPISISSKYQILFELCLGSFQGLVVAVLYCFLNSE
VQCELKRKWRSCPTPSASRDYRVCGSSFSRNGSEGALQFHRGSRAQSFLQTETSVI
(SEQ ID NO: 1145)

>gi|21426829|ref|NP_658986.1|prokineticin receptor 2 {Homo sapiens}
MAAQNGNTSFTPNFNPPQDHASSLSFNFSYGDYDLPMDEDEDMTKTRTFFAAKIVIGIALAGI
MLVCGIGNFVFIAALTRYKKLRNLTNLLIANLAISDFLVAIICCPFEMDYYVVRQLSWEHGHV
LCASVNYLRTVSLYVSTNALLAIAIDRYLAIVHPLKPRMNYQTASFLIALVWMVSILIAIPSAY
FATETVLFIVKSQEKIFCGQIWPVDQQLYYKSYFLFIFGVEFVGPVVTMTLCYARISRELWFK
AVPGFQTEQIRKRLRCRRKTVLVLMCILTAYVLCWAPFYGFTIVRDFFPTVFVKEKHYLTAF
YVVECIAMSNSMINTVCFVTVKNNTMKYFKKMMLLHWRPSQRGSKSSADLDLRTNGVPTT
EEVDCIRLK
(SEQ ID NO: 1146)

>gi|22507376|ref|NP_683765.1|oxoeicosanoid receptor 1 {Homo sapiens}
MLCHRGGQLIVPIIPLCPEHSCRGRRLQNLLSGPWPKQPMELHNLSSPSPSLSSSVLPPSFSPSP
SSAPSAFTTVGGSSGGPCHPTSSSLVSAFLAPILALEFVLGLVGNSLALFIFCIHTRPWTSNTVF
LVSLVAADFLLISNLPRVDYYLLHETWRFGAAACKVNLFMLSTNRTASVVFLTAIALNRYL
KVVQPHHVLSRASVGAAARVAGGLWVGILLLNGHLLLSTFSGPSCLSYRVGTKPSASLRWH
QALYLLEFFLPLALILFAIVSIGLTIRNRGLGGQAGPQRAMRVLAMVVAVYTICFLPSIIFGMA
SMVAFWLSACRSLDLCTQLFHGSLAFTYLNSVLDPVLYCFSSPNFLHQSRALLGLTRGRQGP
VSDESSYQPSRQWRYREASRKAEAIGKLKVQGEVSLEKEGSSQG
(SEQ ID NO: 1147)

>gi|23238240|ref|NP_000677.2|type-2 angiotensin II receptor {Homo sapiens}
MKGNSTLATTSKNITSGLHFGLVNISGNNESTLNCSQKPSDKHLDAIPILYYIIFVIGFLVNIVV
VTLFCCQKGPKKVSSIYIFNLAVADLLLLATLPLWATYYSRYDWLFGPVMCKVFGSFLTLN
MFASIFFITCMSVDRYQSVIYPFLSQRRNPWQASYIVPLVWCMACLSSLPTFYFRDVRTIEYLG TABLE 4-continued Targets from which the Analogs are derived VNACIMAFPPEKYAQWSAGIALMKNILGFIIPLIFIATCYFGIRKHLLKTNSYGKNRITRDQVL
KMAAAVVLAFIICWLPFHVLTFLDALAWMGVINSCEVIAVIDLALPFAILLGFTNSCVNPFLY
CFVGNRFQQKLRSVFRVPITWLQGKRESMSCRKSSSLREMETFVS
(SEQ ID NO: 1148)

>gi|23397681|ref|NP_038475.2|EGF-like module-containing mucin-like hormone receptor-like 2
isoform a {Homo sapiens}
MGGRVFLVFLAFCVWLTLPGAETQDSRGCARWCPQDSSCVNATACRCNPGFSSFSEIITTPM
ETCDDINECATLSKVSCGKFSDCWNTEGSYDCVCSPGYEPVSGAKTFKNESENTCQDVDECQ
QNPRLCKSYGTCVNTLGSYTCQCLPGFKLKPEDPKLCTDVNECTSGQNPCHSSTHCLNNVGS
YQCRCRPGWQPIPGSPNGPNNTVCEDVDECSSGQHQCDSSTVCFNTVGSYSCRCRPGWKPR
HGIPNNQKDTVCEDMTFSTWTPPPGVHSQTLSRFFDKVQDLGRDYKPGLANNTIQSILQALD
ELLEAPGDLETLPRLQQHCVASHLLDGLEDVLRGLSKNLSNGLLNFSYPAGTELSLEVQKQV
DRSVTLRQNQAVMQLDWNQAQKSGDPGPSVVGLVSIPGMGKLLAEAPLVLEPEKQMLLHE
THQGLLQDGSPILLSDVISAFLSNNDTQNLSSPVTFTFSHRSVIPRQKVLCVFWEHGQNGCGH
WATTGCSTIGTRDTSTICRCTHLSSFAVLMAHYDVQEEDPVLTVITYMGLSVSLLCLLLAALT
FLLCKAIQNTSTSLHLQLSLCLFLAHLLFLVAIDQTGHKVLCSIIAGTLHYLYLATLTWMLLEA
LYLFLTARNLTVVNYSSINRFMKKLMPPVGYGVPAVTVAISAASRPHLYGTPSRCWLQPEKG
FIWGFLGPVCAIFSVNLVLFLVTLWILKNRLSSLNSEVSTLRNTRMLAFKATAQLFILGCTWC
LGILQVGPAARVMAYLFTIINSLQGVFIFLVYCLLSQQVREQYGKWSKGIRKLKTESEMHTLS
SSAKADTSKPSTVN
(SEQ ID NO: 1149)

>gi|23463303|ref|NP_002557.2|purinergic receptor P2Y11 {Homo sapiens}
MAANVSGAKSCPANFLAAADDKLSGFQGDFLWPILVVEFLVAVASNGLALYRFSIRKQRPW
HPAVVFSVQLAVSDLLCALTLPPLAAYLYPPKHWRYGEAACRLERFLFTCNLLGSVIFITCISL
NRYLGIVHPFFARSHLRPKHAWAVSAAGWVLAALLAMPTLSFSHLKRPQQGAGNCSVARPE
ACIKCLGTADHGLAAYRAYSLVLAGLGCGLPLLLTLAAYGALGRAVLRSPGMTVAEKLRVA
ALVASGVALYASSYVPYHIMRVLNVDARRRWSTRCPSFADIAQATAALELGPYVGYQVMR
GLMPLAFCVHPLLYMAAVPSLGCCCRHCPGYRDSWNPEDAKSTGQALPLNATAAPKPSEPQ
SRELSQ
(SEQ ID NO: 1150)

>gi|23592220|ref|NP_703143.1|G-protein coupled receptor 26 {Homo sapiens}
MNSWDAGLAGLLVGTMGVSLLSNALVLLCLLHSADIRRQAPALFTLNLTCGNLLCTVVNMP
LTLAGVVAQRQPAGDRLCRLAAFLDTFLAANSMLSMAALSIDRWVAVVFPLSYRAKMRLR
DAALMVAYTWLHALTFPAAALALSWLGFHQLYASCTLCSRRPDERLRFAVFTGAFHALSFL
LSFVVLCCTYLKVLKVARFHCKRIDVITMQTLVLLVDLHPSVRERCLEEQKRRRQRATKKIST
FIGTFLVCFAPYVITRLVELFSTVPIGSHWGVLSKCLAYSKAASDPFVYSLLRHQYRKSCKEIL
NRLLHRRSIHSSGLTGDSHSQNILPVSE
(SEQ ID NO: 1151)

>gi|24475871|ref|NP_722579.1|G protein-coupled receptor 114 precursor {Homo sapiens}
MDHCGALFLCLCLLTLQNATTETWEELLSYMENMQVSRGRSSVFSSRQLHQLEQMLLNTSF
PGYNLTLQTPTIQSLAFKLSCDFSGLSLTSATLKRVPQAGGQHARGQHAMQFPAELTRDACK
TRPRELRLICIYFSNTHFFKDENNSSLLNNYVLGAQLSHGHVNNLRDPVNISFWHNQSLEGYT
LTCVFWKEGARKQPWGGWSPEGCRTEQPSHSQVLCRCNHLTYFAVLMQLSPALVPAELLAP
LTYISLVGCSISIVASLITVLLHFHFRKQSDSLTRIHMNLHAVSLLLNIAFLLSPAFAMSPVPGS
ACTALAAALHYALLSCLTWMAIEGFNLYLLLGRVYNIYIRRYVFKLGVLGWGAPALLVLLS
LSVKSSVYGPCTIPVFDSWENGTGFQNMSICWVRSPVVHSVLVMGYGGLTSLFNLVVLAWA
LWTLRRLRERADAPSVRACHDTVTVLGLTVLLGTTWALAFFSFGVFLLPQLFLFTILNSLYGF
FLFLWFCSQRCRSEAEAKAQIEAFSSSQTTQ
(SEQ ID NO: 1152)

>gi|24476016|ref|NP_722561.1|G protein-coupled receptor 161 isoform 2 {Homo sapiens}
MSLNSSLSCRKELSNLTEEEGGEGGVIITQFIAIIVITIFVCLHVLVIVVTLYKKSYLLTLSNKFV
FSLTLSNFLLSVLVLPFVVTSSIRREWIFGVVWCNFSALLYLLISSASMLTLGVIAIDRYYAVL
YPMVYPMKITGNRAVMALVYIWLHSLIGCLPPLFGWSSVEFDEFKWMCVAAWHREPGYTA
FWQIWCALFPFLVMLVCYGFIFRVARVKARKVHCGTVVIVEEDAQRTGRKNSSTSTSSSGSR
RNAFQGVVYSANQCKALITILVVLGAFMVTWGPYMVVIASEALWGKSSVSPSLETWATWLS
FASAVCHPLIYGLWNKTVRKELLGMCFGDRYYREPFVQRQRTSRLFSISNRITDLGLSPHLTA
LMAGGQPLGHSSSTGDTGFSCSQDSGTDMMLLEDYTSDDNPPSHCTCPPKRRSSVTFEDEVE
QIKEAAKNSILHVKAEVHKSLDSYAASLAKAIEAEAKINLFGEEALPGVLVTARTVPGGGFG
GRRGSRTLVSQRLQLQSIEEGDVLAAEQR
(SEQ ID NO: 1153)

>gi|28173558|ref|NP_778237.1|trace amine-associated receptor 6 {Homo sapiens}
MSSNSSLLVAVQLCYANVNGSCVKIPFSPGSRVILYIVFGFGAVLAVFGNLLVMISILHFKQLH
SPTNFLVASLACADFLVGVTVMPFSMVRTVESCWYFGRSFCTFHTCCDVAFCYSSLFHLCFIS
IDRYIAVTDPLVYPTKFTVSVSGICISVSWILPLMYSGAVFYTGVYDDGLEELSDALNCIGGCQ
TVVNQNWVLTDFLSFFIPTFIMIILYGNIFLVARRQAKKIENTGSKTESSSESYKARVARRERK
AAKTLGVTVVAFMISWLPYSIDSLIDAFMGFITPACIYEICCWCAYYNSAMNPLIYALFYPWF
RKAIKVIVTGQVLKNSSATMNLFSEHI
(SEQ ID NO: 1154)

>gi|28466969|ref|NP_000944.1|prostaglandin D2 receptor {Homo sapiens}
MKSPFYRCQNTTSVEKGNSAVMGGVLFSTGLLGNLLALGLLARSGLGWCSRRPLRPLPSVFY
MLVCGLTVTDLLGKCLLSPVVLAAYAQNRSLRVLAPALDNSLCQAFAFFMSFFGLSSTLQLL TABLE 4-continued Targets from which the Analogs are derived AMALECWLSLGHPFFYRRHITLRLGALVAPVVSAFSLAFCALPFMGFGKFVQYCPGTWCFIQ
MVHEEGSLSVLGYSVLYSSLMALLVLATVLCNLGAMRNLYAMHRRLQRHPRSCTRDCAEP
RADGREASPQPLEELDHLLLLALMTVLFTMCSLPVIYRAYYGAFKDVKEKNRTSEEAEDLRA
LRFLSVISIVDPWIFIIFRSPVFRIFFHKIFIRPLRYRSRCSNSTNMESSL
(SEQ ID NO: 1155)

>gi|28872720|ref|NP_002555.2|P2Y purinoceptor 2 {Homo sapiens}
MAADLGPWNDTINGTWDGDELGYRCRFNEDFKYVLLPVSYGVVCVPGLCLNAVALYIFLC
RLKTWNASTTYMFHLAVSDALYAASLPLLVYYARGDHWPFSTVLCKLVRFLFYTNLYCSI
LFLTCISVHRCLGVLRPLRSLRWGRARYARRVAGAVWVLVLACQAPVLYFVTTSARGGRVT
CHDTSAPELFSRFVAYSSVMLGLLFAVPFAVILVCYVLMARRLLKPAYGTSGGLPRAKRKSV
RTIAVVLAVFALCFLPFHVTRTLYYSFRSLDLSCHTLNAINMAYKVTRPLASANSCLDPVLYF
LAGQRLVRFARDAKPPTGPSPATPARRRLGLRRSDRTDMQRIEDVLGSSEDSRRTESTPAGSE
NTKDIRL
(SEQ ID NO: 1156)

>gi|28875799|ref|NP_795344.1|gastrin/cholecystokinin type B receptor {Homo sapiens}
MELLKLNRSVQGTGPGPGASLCRPGAPLLNSSSVGNLSCEPPRIRGAGTRELELAIRITLYAVI
FLMSVGGNMLIIVVLGLSRRLRTVTNAFLLSLAVSDLLLAVCMPFTLLPNLMGTFIFGTVIC
KAVSYLMGVSVSVSTLSLVAIALERYSAICRPLQARVWQTRSHAARVIVATWLLSGLLMVPY
PVYTVVQPVGPRVLQCVHRWPSARVRQTWSVLLLLLLFFIPGVVMAVAYGLISRELYLGLRF
DGDSDSDSQSRVRNQGGLPGAVHQNGRCRPETGAVGEDSDGCYVQLPRSRPALELTALTAP
GPGSGSRPTQAKLLAKKRVVRMLLVIVVLFFLCWLPVYSANTWRAFDGPGAHRALSGAPISF
IHLLSYASACVNPLVYCFMHRRFRQACLETCARCCPRPPRARPRALPDEDPPTPSIASLSRLSY
TTISTLGPG
(SEQ ID NO: 1157)

>gi|29171311|ref|NP_808219.1|G-protein coupled receptor 109A {Homo sapiens}
MNRHHLQDHFLEIDKKNCCVFRDDFIVKVLPPVLGLEFIFGLLGNGLALWIFCFHLKSWKSSR
IFLFNLAVADFLLIICLPFLMDNYVRRWDWKFGDIPCRLMLFMLAMNRQGSIIFLTVVAVDR
YFRVVHPHHALNKISNRTAAIISCLLWGITIGLTVHLLKKKMPIQNGGANLCSSFSICHTFQWH
EAMFLLEFFLPLGIILFCSAREIISLRQRQMDRHAKIKRAITFIMVVAIVFVICFLPSVVVRIRIF
WLLHTSGTQNCEVYRSVDLAFFITLSFTYMNSMLDPVVYYFSSPSFPNFFSTLINRCLQRKMT
GEPDNNRSTSVELTGDPNKTRGAPEALMANSGEPWSPSYLGPTSP
(SEQ ID NO: 1158)

>gi|29171759|ref|NP_001109.2|pituitary adenylate cyclase-activating polypeptide type 1 receptor
precursor {Homo sapiens}
MAGVVHVSLAALLLLPMAPAMHSDCIFKKEQAMCLEKIQRANELMGFNDSSPGCPGMWDN
ITCWKPAHVGEMVLVSCPELFRIFNPDQVWETETIGESDFGDSNSLDLSDMGVVSRNCTEDG
WSEPFPHYFDACGFDEYESETGDQDYYYLSVKALYTVGYSTSLVTLTTAMVILCRFRKLHCT
RNFIHMNLFVSFMLRAISVFIKDWILYAEQDSNHCFISTVECKAVMVFFHYCVVSNYFWLFIE
GLYLFTLLVETFFPERRYFYWYTIIGWGTPTVCVTVWATLRLYFDDTGCWDMNDSTALWW
VIKGPVVGSIMVNFVLFIGIIVILVQKLQSPDMGGNESSIYLRLARSTLLLIPLFGIHYTVFAFSP
ENVSKRERLVFELGLGSFQGFVVAVLYCFLNGEVQAEIKRKWRSWKVNRYFAVDFKHRHPS
LASSGVNGGTQLSILSKSSSQIRMSGLPADNLAT
(SEQ ID NO: 1159)

>gi|30023826|ref|NP_835230.1|P2Y purinoceptor 8 {Homo sapiens}
MQVPNSTGPDNATLQMLRNPAIAVALPVVYSLVAAVSIPGNLFSLWVLCRRMGPRSPSVIFM
INLSVTDLMLASVLPFQIYYHCNRHHWVFGVLLCNVVTVAFYANMYSSILTMTCISVERFLG
VLYPLSSKRWRRRRYAVAACAGTWLLLLTALSPLARTDLTYPVHALGITCVKVWTMLPS
VAMWAVFLFTIFILLFLIPFVITVACYTATILKLLRTEEAHGREQRRRAVGLAAVVLLAFVTCF
APNNFVLLAHIVSRLFYGKSYYHVYKLTLCLSCLNNCLDPFVYYFASREFQLRLREYLGCRR
VPRDTLDTRRESLFSARTTSVRSEAGAHPEGMEGATRPGLQRQESVF
(SEQ ID NO: 1160)

>gi|30425400|ref|NP_848566.1|glucose-dependent insulinotropic receptor {Homo sapiens}
MESSFSFGVILAVLASLIIATNTLVAVAVLLLIHKNDGVSLCFTLNLAVADTLIGVAISGLLTD
QLSSPSRPTQKTLCSLRMAFVTSSAAASVLTVMLITFDRYLAIKQPFRYLKIMSGFVAGACIA
GLWLVSYLIGFLPLGIPMFQQTAYKGQCSFFAVFHPHFVLTLCVGFFPAMLLFVFFYCDMLK
IASMHSQQIRKMEHAGAMAGGYRSPRTPSDFKALRTVSVLIGSFALSWTPFLITGIVQVACQE
CHLYLVLERYLWLLGVGNSLLNPLIYAYWQKEVRLQLYHMALGVKKVLTSFLLFLSARNCG
PERPRESSCHIVTISSSEFDG
(SEQ ID NO: 1161)

>gi|30581164|ref|NP_005277.2|neuropeptides B/W receptor type 2 {Homo sapiens}
MQAAGHPEPLDSRGSFSLPTMGANVSQDNGTGHNATFSEPLPFLYVLLPAVYSGICAVGLTG
NTAVILVILRAPKMKTVTNVFILNLAVADGLFTLVLPVNIAEHLLQYWPFGELLCKLVLAVD
HYNIFSSIYFLAVMSVDRYLVVLATVRSHMPWRTYRGAKVASLCVWLGVTVLVLPFFSFA
GVYSNELQVPSCGLSFPWPEQVWFKASRVYTLVLGFVLPVCTICVLYTDLLRRLRAVRLSRG
AKALGKARRKVTVLVLVVLAVCLLCWTPFHLASVVALTTDLPQTPLVISMSYVITSLSYANS
CLNPFLYAFLDDNFRKNFRSILRC
(SEQ ID NO: 1162)

>gi|30795217|ref|NP_848540.1|chemokine (C-C motif) receptor-like 1 {Homo sapiens}
MALEQNQSTDYYYEENEMNGTYDYSQYELICIKEDVREFAKVFLPVFLTIVFVIGLAGNSMV
VAIYAYYKKQRTKTDVYILNLAVADLLLLFTLPFWAVNAVHGWVLGKIMCKITSALYTLNF TABLE 4-continued Targets from which the Analogs are derived VSGMQFLACISIDRYVAVTKVPSQSGVGKPCWIICFCVWMAAILLSIPQLVFYTVNDNARCIPI
FPRYLGTSMKALIQMLEICIGFVVPFLIMGVCYFITARTLMKMPNIKISRPLKVLLTVVIVFIVT
QLPYNIVKFCRAIDIIYSLITSCNMSKRMDIAIQVTESIALFHSCLNPILYVFMGASFKNYVMKV
AKKYGSWRRQRQSVEEFPFDSEGPTEPTSTFSI
(SEQ ID NO: 1163)

>gi|31083315|ref|NP_009158.3|probable G-protein coupled receptor 45 {Homo sapiens}
MACNSTSLEAYTYLLLNTSNASDSGSTQLPAPLRISLAIVMLLMTVVGFLGNTVVCIIVYQRP
AMRSAINLLLATLAFSDIMLSLCCMPFTAVTLITVRWHFGDHFCRLSATLYWFFVLEGVAILL
IISVDRFLIIVQRQDKLNPRRAKVIIAVSWVLSFCIAGPSLTGWTLVEVPARAPQCVLGYTELP
ADRAYVVTLVVAVFFAPFGVMLCAYMCILNTVRKNAVRVHNQSDSLDLRQLTRAGLRRLQ
RQQQVSVDLSFKTKAFTTILILFVGFSLCWLPHSVYSLLSVFSQRFYCGSSFYATSTCVLWLSY
LKSVFNPIVYCWRIKKFREACIELLPQTFQILPKVPERIRRRIQPSTVYVCNENQSAV
(SEQ ID NO: 1164)

>gi|31083344|ref|NP_064707.1|C-X-C chemokine receptor type 7 {Homo sapiens}
MDLHLFDYSEPGNFSDISWPCNSSDCIVVDTVMCPNMPNKSVLLYTLSFIYIFIFVIGMIANSV
VVWVNIQAKTTGYDTHCYILNLAIADLWVVLTIPVWVVSLVQHNQWPMGELTCKVTHLIFS
INLFGSIFFLTCMSVDRYLSITYFTNTPSSRKKMVRRVVCILVWLLAFCVSLPDTYYLKTVTSA
SNNETYCRSFYPEHSIKEWLIGMELVSVVLGFAVPFSIIAVFYFLLARAISASSDQEKHSSRKIIF
SYVVVFLVCWLPYHVAVLLDIFSILHYIPFTCRLEHALFTALHVTQCLSLVHCCVNPVLYSFIN
RNYRYELMKAFIFKYSAKTGLTKLIDASRVSETEYSALEQSTK
(SEQ ID NO: 1165)

>gi|31657138|ref|NP_000136.2|follicle-stimulating hormone receptor isoform 1 precursor {Homo sapiens}
MALLLVSLLAFLSLGSGCHHRICHCSNRVFLCQESKVTEIPSDLPRNAIELRFVLTKLRVIQKG
AFSGFGDLEKIEISQNDVLEVIEADVFSNLPKLHEIRIEKANNLLYINPEAFQNLPNLQYLLISN
TGIKHLPDVHKIHSLQKVLLDIQDNINIHTIERNSFVGLSFESVILWLNKNGIQEIHNCAFNGTQ
LDELNLSDNNNLEELPNDVFHGASGPVILDISRTRIHSLPSYGLENLKKLRARSTYNLKKLPTL
EKLVALMEASLTYPSHCCAFANWRRQISELHPICNKSILRQEVDYMTQARGQRSSLAEDNES
SYSRGFDMTYTEFDYDLCNEVVDVTCSPKPDAFNPCEDIMGYNILRVLIWFISILAITGNIIVLV
ILTTSQYKLTVPRFLMCNLAFADLCIGIYLLLIASVDIHTKSQYHNYAIDWQTGAGCDAAGFF
TVFASELSVYTLTAITLERWHTITHAMQLDCKVQLRHAASVMVMGWIFAFAAALFPIFGISSY
MKVSICLPMDIDSPLSQLYVMSLLVLNVLAFVVICGCYIHIYLTVRNPNIVSSSSDTRIAKRMA
MLIFTDFLCMAPISFFAISASLKVPLITVSKAKILLVLFHPINSCANPFLYAIFTKNFRRDFFILLS
KCGCYEMQAQIYRTETSSTVHNTHPRNGHCSSAPRVTSGSTYILVPLSHLAQN
(SEQ ID NO: 1166)

>gi|31881630|ref|NP_000947.2|prostaglandin E2 receptor EP2 subtype {Homo sapiens}
MGNASNDSQSEDCETRQWLPPGESPAISSVMFSAGVLGNLIALALLARRWRGDVGCSAGRR
SSLSLFHVLVTELVFTDLLGTCLISPVVLASYARNQTLVALAPESRACTYFAFAMTFFSLATM
LMLFAMALERYLSIGHPYFYQRRVSRSGGLAVLPVIYAVSLLFCSLPLLDYGQYVQYCPGTW
CFIRHGRTAYLQLYATLLLLLIVSVLACNFSVILNLIRMHRRSRRSRCGPSLGSGRGGPGARRR
GERVSMAEETDHLILLAIMTITFAVCSLPFTIFAYMNETSSRKEKWDLQALRFLSINSIIDPWVF
AILRPPVLRLMRSVLCCRISLRTQDATQTSCSTQSDASKQADL
(SEQ ID NO: 1167)

>gi|31881792|ref|NP_858043.1|leukotriene B4 receptor 1 {Homo sapiens}
MNTTSSAAPPSLGVEFISLLAIILLSVALAVGLPGNSFVVWSILKRMQKRSVTALMVLNLALA
DLAVLLTAPFFLHFLAQGTWSFGLAGCRLCHYVCGVSMYASVLLITAMSLDRSLAVARPFVS
QKLRTKAMARRVLAGIWVLSFLLATPVLAYRTVVPWKTNMSLCFPRYPSEGHRAFHLIFEA
VTGFLLPFLAVVASYSDIGRRLQARRFRRSRRTGRLVVLIILTFAAFWLPYHVVNLAEAGRAL
AGQAAGLGLVGKRLSLARNVLIALAFLSSSVNPVLYACAGGGLLRSAGVGFVAKLLEGTGS
EASSTRRGGSLGQTARSGPAALEPGPSESLTASSPLKLNELN
(SEQ ID NO: 1168)

>gi|32261309|ref|NP_072093.2|probable G-protein coupled receptor 135 {Homo sapiens}
MEEPQPPRPPASMALLGSQHSGAPSAAGPPGGTSSAATAAVLSFSTVATAALGNLSDASGGG
TAAAPGGGGLGGSGAAREAGAAVRRPLGPEAAPLLSHGAAVAAQALVLLLIFLLSSLGNCA
VMGVIVKHRQLRTVTNAFILSLSLSDLLTALLCLPAAFLDLFTPPGGSAPAAAAGPWRGFCA
ASRFFSSCFGIVSTLSVALISLDRYCAIVRPPREKIGRRRALQLLAGAWLTALGFSLPWELLGA
PRELAAAQSFHGCLYRTSPDPAQLGAAFSVGLVVACYLLPFLLMCFCHYHICKTVRLSDVRV
RPVNTYARVLRFFSEVRTATTVLIMIVFVICCWGPYCFLVLLAAARQAQTMQAPSLLSVVAV
WLTWANGAINPVIYAIRNPNISMLLGRNREEGYRTRNVDAFLPSQGPGLQARSRSRLRNRYA
NRLGACNRMSSSNPASGVAGDVAMWARKNPVVLFCREGPPEPVTAVTKQPKSEAGDTSL
(SEQ ID NO: 1169)

>gi|32307152|ref|NP_000907.2|oxytocin receptor {Homo sapiens}
MEGALAANWSAEAANASAAPPGAEGNRTAGPPRRNEALARVEVAVLCLILLLALSGNACVL
LALRTTRQKHSRLFFFMKHLSIADLVVAVFQVLPQLLWDITFRFYGPDLLCRLVKYLQVVGM
FASTYLLLLMSLDRCLAICQPLRSLRRRTDRLAVLATWLGCLVASAPQVHIFSLREVADGVF
DCWAVFIQPWGPKAYITWITLAVYIVPVIVLAACYGLISFKIWQNLRLKTAAAAAEAPEGA
AAGDGGRVALARVSSVKLISKAKIRTVKMTFIIVLAFIVCWTPFFFVQMWSVWDANAPKEAS
AFIIVMLLASLNSCCNPWIYMLFTGHLFHELVQRFLCCSASYLKGRRLGETSASKKSNSSSFV
LSHRSSSQRSCSQPSTA
(SEQ ID NO: 1170)

TABLE 4-continued

Targets from which the Analogs are derived

>gi|32307159|ref|NP_001874.2|corticotropin-releasing factor receptor 2 precursor {Homo sapiens}
MDAALLHSLLEANCSLALAEELLLDGWGPPLDPEGPYSYCNTTLDQIGTCWPRSAAGALVE
RPCPEYFNGVKYNTTRNAYRECLENGTWASKINYSQCEPILDDKQRKYDLHYRIALVVNYL
GHCVSVAALVAAFLLFLALRSIRCLRNVIHWNLITTFILRNVMWFLLQLVDHEVHESNEVWC
RCITTIFNYFVVTNFFWMFVEGCYLHTAIVMTYSTERLRKCLFLFIGWCIPFPIIVAWAIGKLY
YENEQCWFGKEPGDLVDYIYQGPIILVLLINFVFLFNIVRILMTKLRASTTSETIQYRKAVKAT
LVLLPLLGITYMLFFVNPGEDDLSQIMFIYFNSFLQSFQGFFVSVFYCFFNGEVRSAVRKRWH
RWQDHHSLRVPMARAMSIPTSPTRISFHSIKQTAAV
(SEQ ID NO: 1171)

>gi|32401433|ref|NP_861455.1|G protein-coupled receptor 142 {Homo sapiens}
MSIMMLPMEQKIQWVPTSLQDITAVLGTEAYTEEDKSMVSHAQKSQHSCLSHSRWLRSPQV
TGGSWDLRIRPSKDSSSFRQAQCLRKDPGANNHLESQGVRGTAGDADRELRGPSEKATAGQ
PRVTLLPTPHVSGLSQEFESHWPEIAERSPCVAGVIPVIYYSVLLGLGLPVSLLTAVALARLAT
RTRRPSYYYLLALTASDIIQVVIVFAGFLLQGAVLARQVPQAVVRTANILEFAANHASVWIAI
LLTVDRYTALCHPLHHRAASSPGRTRRAIAAVLSAALLTGIPFYWWLDMWRDTDSPRTLDE
VLKWAHCLTVYFIPCGVFLVTNSAIIHRLRRRGRSGLQPRVGKSTAILLGITTLFTLLWAPRVF
VMLYHMYVAPVHRDWRVHLALDVANMVAMLHTAANFGLYCFVSKTFRATVRQVIHDAY
LPCTLASQPEGMAAKPVMEPPGLPTGAEV
(SEQ ID NO: 1172)

>gi|32401435|ref|NP_861456.1|G protein-coupled receptor 141 {Homo sapiens}
MPGHNTSRNSSCDPIVTPHLISLYFIVLIGGLVGVISILFLLVKMNTRSVTTMAVINLVVVHSVF
LLTVPFRLTYLIKKTWMFGLPFCKFVSAMLHIHMYLTFLFYVVILVTRYLIFFKCKDKVEFYR
KLHAVAASAGMWTLVIVIVVPLVVSRYGIHEEYNEEHCFKPHKELAYTYVKIINYMIVIFVIA
VAVILLVFQVFIIMLMVQKLRHSLLSHQEFWAQLKNLFFIGVILVCFLPYQFFRIYYLNVVTHS
NACNSKVAFYNEIFLSVTAISCYDLLLFVFGGSHWFKQKIIGLWNCVLCR
(SEQ ID NO: 1173)

>gi|32483397|ref|NP_000788.2|d(4) dopamine receptor {Homo sapiens}
MGNRSTADADGLLAGRGPAAGASAGASAGLAGQGAAALVGGVLLIGAVLAGNSLVCVSVA
TERALQTPTNSFIVSLAAADLLLALLVLPLFVYSEVQGGAWLLSPRLCDALMAMDVMLCTA
SIFNLCAISVDRFVAVAVPLRYNRQGGSRRQLLLIGATWLLSAAVAAPVLCGLNDVRGRDPA
VCRLEDRDYVVYSSVCSFFLPCPLMLLLYWATFRGLQRWEVARRAKLHGRAPRRPSGPGPP
SPTPPAPRLPQDPCGPDCAPPAPGLPRGPCGPDCAPAAPSLPQDPCGPDCAPPAPGLPPDPCGS
NCAPPDAVRAAALPPQTPPQTRRRRRAKITGRERKAMRVLPVVVGAFLLCWTPFFVVHITQA
LCPACSVPPRLVSAVTWLGYVNSALNPVIYTVFNAEFRNVFRKALRACC
(SEQ ID NO: 1174)

>gi|32490567|ref|NP_871001.1|relaxin-3 receptor 2 {Homo sapiens}
MPTLNTSASPPTFFWANASGGSVLSADDAPMPVKFLALRLMVALAYGLVGAIGLLGNLAVL
WVLSNCARRAPGPPSDTFVFNLALADLGLALTLPFWAAESALDFHWPFGGALCKMVLTATV
LNVYASIFLITALSVARYWVVAMAAGPGTHLSLFWARIATLAVWAAAALVTVPTAVFGVEG
EVCGVRLCLLRFPSRYWLGAYQLQRVVLAFMVPLGVITTSYLLLLAFLQRRQRRQDSRVV
ARSVRILVASFFLCWFPNHVVTLWGVLVKFDLVPWNSTFYTIQTYVFPVTTCLAHSNSCLNP
VLYCLLREPRQALAGTFRDLRLRLWPQGGGWVQQVALKQVGRRWVASNPRESRPSTLLT
NLDRGTPG
(SEQ ID NO: 1175)

>gi|33598960|ref|NP_000673.2|alpha-2B adrenergic receptor {Homo sapiens}
MDHQDPYSVQATAAIAAAITFLILFTIFGNALVILAVLTSRSLRAPQNLFLVSLAAADILVATLI
IPFSLANELLGYWYFRRTWCEVYLALDVLFCTSSIVHLCAISLDRYWAVSRALEYNSKRTPRR
IKCIILTVWLIAAVISLPPLIYKGDQGPQPRGRPQCKLNQEAWYILASSIGSFFAPCLIMILVYLR
IYLIAKRSNRRGPRAKGGPGQGESKQPRPDHGGALASAKLPALASVASAREVNGHSKSTGEK
EEGETPEDTGTRALPPSWAALPNSGQGQKEGVCGASPEDEAEEEEEEEEEEECEPQAVPVSP
ASACSPPLQQPQGSRVLATLRGQVLLGRGVGAIGGQWWRRRAQLTREKRFTFVLAVVIGVF
VLCWFPFFFFSYSLGAICPKHCKVPHGLFQFFFWIGYCNSSLNPVIYTIFNQDFRRAFRRILCRP
WTQTAW
(SEQ ID NO: 1176)

>gi|33695097|ref|NP_005292.2|G protein-coupled receptor 35 {Homo sapiens}
MNGTYNTCGSSDLTWPPAIKLGFYAYLGVLLVLGLLLNSLALWVFCCRMQQWTETRIYMT
NLAVADLCLLCTLPFVLHSLRDTSDTPLCQLSQGIYLTNRYMSISLVTAIAVDRYVAVRHPLR
ARGLRSPRQAAAVCAVLWVLVIGSLVARWLLGIQEGGFCFRSTRHNFNSMAFPLLGFYLPLA
VVVFCSLKVVTALAQRPPTDVGQAEATRKAARMVWANLLVFVVCFLPLHVGLTVRLAVG
WNACALLETIRRALYITSKLSDANCCLDAICYYYMAKEFQEASALAVAPSAKAHKSQDSLCV
TLA
(SEQ ID NO: 1177)

>gi|33695104|ref|NP_003599.2|G protein-coupled receptor 65 {Homo sapiens}
MNSTCIEEQHDLDHYLFPIVYIFVIIVSIPANIGSLCVSFLQAKKESELGIYLFSLSLSDLLYALT
LPLWIDYTWNKDNWTFSPALCKGSAFLMYMNFYSSTAFLTCIAVDRYLAVVYPLKFFFLRTR
RFALMVSLSIWILETIFNAVMLWEDETVVEYCDAEKSNFTLCYDKYPLEKWQINLNLFRTCT
GYAIPLVTILICNRKVYQAVRHNKATENKEKKRIIKLLVSITVTFVLCFTPFHVMLLIRCILEHA
VNFEDHSNSGKRTYTMYRITVALTSLNCVADPILYCFVTETGRYDMWNILKFCTGRCNTSQR
QRKRILSVSTKDTMELEVLE
(SEQ ID NO: 1178)

TABLE 4-continued

Targets from which the Analogs are derived

>gi|33695107|ref|NP_005674.2|G-protein coupled receptor 55 {Homo sapiens}
MSQQNTSGDCLFDGVNELMKTLQFAVHIPTFVLGLLLNLLAIHGFSTFLKNRWPDYAATSIY
MINLAVFDLLLVLSLPFKMVLSQVQSPFPSLCTLVECLYFVSMYGSVFTICFISMDRFLAIRYP
LLVSHLRSPRKIFGICCTIWVLVWTGSIPIYSFHGKVEKYMCFHNMSDDTWSAKVFFPLEVFG
FLLPMGIMGFCCSRSIHILLGRRDHTQDWVQQKACIYSIAASLAVFVVSFLPVHLGFFLQFLV
RNSFIVECRAKQSISFFLQLSMCFSNVNCCLDVFCYYFVIKEFRMNIRAHRPSRVQLVLQDTTI
SRG
(SEQ ID NO: 1179)

>gi|33695113|ref|NP_005758.2|G-protein coupled purinergic receptor P2Y5 {Homo sapiens}
MVSVNSSHCFYNDSFKYTLYGCMFSMVFVLGLISNCVAIYIFICVLKVRNETTTYMINLAMS
DLLFVFTLPFRIFYFTTRNWPFGDLLCKISVMLFYTNMYGSILFLTCISVDRFLAIVYPFKSKTL
RTKRNAKIVCTGVWLTVIGGSAPAVFVQSTHSQGNNASEACFENFPEATWKTYLSRIVIFIEIV
GFFIPLILNVTCSSMVLKTLTKPVTLSRSKINKTKVLKMIFVHLIIFCFCFVPYNINLILYSLVRT
QTFVNCSVVAAVRTMYPITLCIAVSNCCFDPIVYYFTSDTIQNSIKMKNWSVRRSDFRFSEVH
GAENFIQHNLQTLKSKIFDNESAA
(SEQ ID NO: 1180)

>gi|34577052|ref|NP_005233.3|proteinase-activated receptor 2 precursor {Homo sapiens}
MRSPSAAWLLGAAILLAASLSCSGTIQGTNRSSKGRSLIGKVDGTSHVTGKGVTVETVFSVDE
FSASVLTGKLTTVFLPIVYTIVFVVGLPSNGMALWVFLFRTKKKHPAVIYMANLALADLLSVI
WFPLKIAYHIHGNNWIYGEALCNVLIGFFYGNMYCSILFMTCLSVQRYWVIVNPMGHSRKK
ANIAIGISLAIWLLILLVTIPLYVVKQTIFIPALNITTCHDLVPEQLLVGDMFNYFLSLAIGVFLF
PAFLTASAYVLMIRMLRSSAMDENSEKKRKRAIKLIVTVLAMYLICFTPSNLLLVVHYFLIKS
QGQSHVYALYIVALCLSTLNSCIDPFVYYFVSHDFRDHAKNALLCRSVRTVKQMQVSLTSKK
HSRKSSSYSSSSTTVKTSY
(SEQ ID NO: 1181)

>gi|36951012|ref|NP_005270.2|probable G-protein coupled receptor 1 {Homo sapiens}
MEDLEETLFEEFENYSYDLDYYSLESDLEEKVQLGVVHWVSLVLYCLAFVLGIPGNAIVIWF
TGFKWKKTVTTLWFLNLAIADFIFLLFLPLYISYVAMNFHWPFGWLKCKANSFTAQLNMFAS
VFFLTVISLDHYIHLIHPVLSHRHRTLKNSLIVIIFIWLLASLIGGPALYFRDTVEFNNHTLCYNN
FQKHDPDLTLIRHHVLTWVKFIIGYLFPLLTMSICYLCLIFKVKKRSILISSRHFWTILVVVVAF
VVCWTPYHLFSIWELTIHHNSYSHHVMQAGIPLSTGLAFLNSCLNPILYVLISKKFQARFRSSV
AEILKYTLWEVSCSGTVSEQLRNSETKNLCLLETAQ
(SEQ ID NO: 1182)

>gi|36951034|ref|NP_543009.2|G-protein coupled receptor 78 {Homo sapiens}
MGPGEALLAGLLVMVLAVALLSNALVLLCCAYSAELRTRASGVLLVNLSLGHLLLAALDMP
FTLLGVMRGRTPSAPGACQVIGFLDTFLASNAALSVAALSADQWLAVGFPLRYAGRLRPRY
AGLLLGCAWGQSLAFSGAALGCSWLGYSSAFASCSLRLPPEPERPRFAAFTATLHAVGFVLP
LAVLCLTSLQVHRVARRHCQRMDTVTMKALALLADLHPSVRQRCLIQQKRRRHRATRKIGI
AIATFLICFAPYVMTRLAELVPFVTVNAQWGILSKCLTYSKAVADPFTYSLLRRPFRQVLAG
MVHRLLKRTPRPASTHDSSLDVAGMVHQLLKRTPRPASTHNGSVDTENDSCLQQTH
(SEQ ID NO: 1183)

>gi|37187860|ref|NP_004358.2|C-C chemokine receptor type 6 {Homo sapiens}
MSGESMNFSDVFDSSEDYFVSVNTSYYSVDSEMLLCSLQEVRQFSRLFVPIAYSLICVFGLLG
NILVVITFAFYKKARSMTDVYLLNMAIADILFVLTLPFWAVSHATGAWVFSNATCKLLKGIY
AINFNCGMLLLTCISMDRYIAIVQATKSFRLRSRTLPRSKIICLVVWGLSVIISSSTFVFNQKYN
TQGSDVCEPKYQTVSEPIRWKLLMLGLELLFGFFIPLMFMIFCYTFIVKTLVQAQNSKRHKAI
RVIIAVVLVFLACQIPHNMVLLVTAANLGKMNRSCQSEKLIGYTKTVTEVLAFLHCCLNPVL
YAFIGQKFRNYFLKILKDLWCVRRKYKSSGFSCAGRYSENISRQTSETADNDNASSFTM
(SEQ ID NO: 1184)

>gi|37577159|ref|NP_000379.2|calcium-sensing receptor precursor {Homo sapiens}
MAFYSCCWVLLALTWHTSAYGPDQRAQKKGDIILGGLFPIHFGVAAKDQDLKSRPESVECIR
YNFRGFRWLQAMIFAIEEINSSPALLPNLTLGYRIFDTCNTVSKALEATLSFVAQNKIDSLNLD
EFCNCSEHIPSTIAVVGATGSGVSTAVANLLGLFYIPQVSYASSSRLLSNKNQFKSFLRTIPNDE
HQATAMADIIEYFRWNWVGTIAADDDYGRPGIEKFREEAEERDICIDFSELISQYSDEEEIQHV
VEVIQNSTAKVIVVFSSGPDLEPLIKEIVRRNITGKIWLASEAWASSSLIAMPQYFHVVGGTIGF
ALKAGQIPGFREFLKKVHPRKSVHNGFAKEFWEETFNCHLQEGAKGPLPVDTFLRGHEESGD
RFSNSSTAFRPLCTGDENISSVETPYIDYTHLRISYNVYLAVYSIAHALQDIYTCLPGRGLFTNG
SCADIKKVEAWQVLKHLRHLNFTNNMGEQVTFDECGDLVGNYSIINWHLSPEDGSIVFKEV
GYYNVYAKKGERLFINEEKILWSGFSREVPFSNCSRDCLAGTRKGIIEGEPTCCFECVECPDGE
YSDETDASACNKCPDDFWSNENHTSCIAKEIEFLSWTEPFGIALTLFAVLGIFLTAFVLGVFIK
FRNTPIVKATNRELSYLLLFSLLCCFSSSLFFIGEPQDWTCRLRQPAFGISFVLCISCILVKTNRV
LLVFEAKIPTSFHRKWWGLNLQFLLVFLCTFMQIVICVIWLYTAPPSSYRNQELEDEIIFITCHE
GSLMALGFLIGYTCLLAAICFFFAFKSRKLPENFNEAKFITFSMLIPFIVWISFIPAYASTYGKFV
SAVEVIAILAASFGLLACIFFNKIYIILFKPSRNTIEEVRCSTAAHAFKVAARATLRRSNVSRKR
SSSLGGSTGSTPSSSISSKSNSEDPFPQPERQKQQQPLALTQQEQQQQPLTLPQQQRSQQQPRC
KQKVIFGSGTVTFSLSFDEPQKNAMAHRNSTHQNSLEAQKSSDTLTRHQPLLPLQCGETDLD
LTVQETGLQGPVGGDQRPEVEDPEELSPALVVSSSQSFVISGGGSTVTENVVNS
(SEQ ID NO: 1185)

>gi|37622910|ref|NP_000729.2|cholinergic receptor, muscarinic 1 {Homo sapiens}
MNTSAPPAVSPNITVLAPGKGPWQVAFIGITTGLLSLATVTGNLLVLISFKVNTELKTVNNYF
LLSLACADLIIGTFSMNLYTTYLLMGHWALGTLACDLWLALDYVASNASVMNLLLISFDRYF TABLE 4-continued Targets from which the Analogs are derived SVTRPLSYRAKRTPRRAALMIGLAWLVSFVLWAPAILFWQYLVGERTVLAGQCYIQFLSQPII
TFGTAMAAFYLPVTVMCTLYWRIYRETENRARELAALQGSETPGKGGGSSSSERSQPGAEG
SPETPPGRCCRCCRAPRLLQAYSWKEEEEEDEGSMESLTSSEGEEPGSEVVIKMPMVDPEAQ
APTKQPPRSSPNTVKRPTKKGRDRAGKGQKPRGKEQLAKRKTFSLVKEKKAARTLSAILLAF
ILTWTPYNIMVLVSTFCKDCVPETLWELGYWLCYVNSTINPMCYALCNKAFRDTFRLLLLCR
WDKRRWRKIPKRPGSVHRTPSRQC
(SEQ ID NO: 1186)

>gi|38194224|ref|NP_005289.2|G protein-coupled receptor 25 {Homo sapiens}
MAPTEPWSPSPGSAPWDYSGLDGLEELELCPAGDLPYGYVYIPALYLAAFAVGLLGNAFVV
WLLAGRRGPRRLVDTFVLHLAAADLGFVLTLPLWAAAAALGGRWPFGDGLCKLSSFALAG
TRCAGALLLAGMSVDRYLAVVKLLEARPLRTPRCALASCCGVWAVALLAGLPSLVYRGLQP
LPGGQDSQCGEEPSHAFQGLSLLLLLLTFVLPLVVTLFCYCRISRRLRRPPHVGRARRNSLRIIF
AIESTFVGSWLPFSALRAVFHLARLGALPLPCPLLLALRWGLTIATCLAFVNSCANPLIYLLLD
RSFRARALDGACGRTGRLARRISSASSLSRDDSSVFRCRAQAANTASASW
(SEQ ID NO: 1187)

>gi|38455410|ref|NP_940799.1|growth hormone secretagogue receptor type 1 isoform 1a {Homo sapiens}
MWNATPSEEPGFNLTLADLDWDASPGNDSLGDELLQLFPAPLLAGVTATCVALFVVGIAGN
LLTMLVVSRFRELRTTTNLYLSSMAFSDLLIFLCMPLDLVRLWQYRPWNFGDLLCKLFQFVS
ESCTYATVLTITALSVERYFAICFPLRAKVVVTKGRVKLVIFVIWAVAFCSAGPIFVLVGVEHE
NGTDPWDTNECRPTEFAVRSGLLTVMVWVSSIFFFLPVFCLTVLYSLIGRKLWRRRRGDAVV
GASLRDQNHKQTVKMLAVVVFAFILCWLPFHVGRYLFSKSFEPGSLEIAQISQYCNLVSFVLF
YLSAAINPILYNIMSKKYRVAVFRLLGFEPFSQRKLSTLKDESSRAWTESSINT
(SEQ ID NO: 1188)

>gi|38455413|ref|NP_002021.3|N-formyl peptide receptor 3 {Homo sapiens}
METNFSIPLNETEEVLPEPAGHTVLWIFSLLVHGVTFVFGVLGNGLVIWVAGFRMTRTVNTIC
YLNLALADFSFSAILPFRMVSVAMREKWPFGSFLCKLVHVMIDINLFVSVYLITIIALDRCICV
LHPAWAQNHRTMSLAKRVMTGLWIFTIVLTLPNFIFWTTISTTNGDTYCIFNFAFWGDTAVE
RLNVFITMAKVFLILHFIIGFSVPMSIITVCYGIIAAKIHRNHMIKSSRPLRVFAAVVASFFICWF
PYELIGILMAVWLKEMLLNGKYKIILVLINPTSSLAFFNSCLNPILYVFMGRNFQERLIRSLPTS
LERALTEVPDSAQTSNTDTTSASPPEETELQAM
(SEQ ID NO: 1189)

>gi|38505172|ref|NP_000948.2|prostaglandin E receptor 3, subtype EP3 isoform 1 {Homo sapiens}
MKETRGYGGDAPFCTRLNHSYTGMWAPERSAEARGNLTRPPGSGEDCGSVSVAFPITMLLT
GFVGNALAMLLVSRSYRRRESKRKKSFLLCIGWLALTDLVGQLLTTPVVIVVYLSKQRWEHI
DPSGRLCTFFGLTMTVFGLSSLFIASAMAVERALAIRAPHWYASHMKTRATRAVLLGVWLA
VLAFALLPVLGVGQYTVQWPGTWCFISTGRGGNGTSSSHNWGNLFFASAFAFLGLLALTVTF
SCNLATIKALVSRCRAKATASQSSAQWGRITTETAIQLMGIMCVLSVCWSPLLIMMLKMIFN
QTSVEHCKTHTEKQKECNFFLIAVRLASLNQILDPWVYLLLRKILLRKFCQMRKRRLREQAP
LLPTSTVIDPSRFCAQPFRWFLDLSFPAMSSSHPQLPLTLASFKLLREPCSVQLS
(SEQ ID NO: 1190)

>gi|38505194|ref|NP_000946.2|prostaglandin E2 receptor EP1 subtype {Homo sapiens}
MSPCGPLNLSLAGEATTCAAPWVPNTSAVPPSGASPALPIFSMTLGAVSNLLALALLAQAAG
RLRRRRSAATFLLFVASLLATDLAGHVIPGALVLRLYTAGRAPAGGACHFLGGCMVFFGLCP
LLLGCGMAVERCVGVTRPLLHAARVSVARARLALAAVAAVALAVALLPLARVGRYELQYP
GTWCFIGLGPPGGWRQALLAGLFASLGLVALLAALVCNTLSGLALLRARWRRRSRPPPAS
GPDSRRRWGAHGPRSASASSASSIASASTFFGGSRSSGSARRARAHDVEMVGQLVGIMVVSC
ICWSPMLVLVALAVGGWSSTSLQRPLFLAVRLASWNQILDPWVYILLRQAVLRQLLRLLPPR
AGAKGGPAGLGLTPSAWEASSLRSSRHSGLSHF
(SEQ ID NO: 1191)

>gi|38678524|ref|NP_859528.1|opsin 5 isoform 1 {Homo sapiens}
MALNHTALPQDERLPHYLRDGDPFASKLSWEADLVAGFYLTIIGILSTFGNGYVLYMSSRRK
KKLRPAEIMTINLAVCDLGISVVGKPFTIISCFCHRWVFGWIGCRWYGWAGFFFGCGSLITMT
AVSLDRYLKICYLSYGVWLKRKHAYICLAAIWAYASFWTTMPLVGLGDYVPEPFGTSCTLD
WWLAQASVGGQVFILNILFFCLLLPTAVIVFSYVKIIAKVKSSSKEVAHFDSRIHSSHVLEMKL
TKVAMLICAGFLIAWIPYAVVSVWSAFGRPDSIPIQLSVVPTLLAKSAAMYNPIIYQVIDYKFA
CCQTGGLKATKKKSLEGFRLHTVTTVRKSSAVLEIHEEWE
(SEQ ID NO: 1192)

>gi|38683844|ref|NP_057167.2|cannabinoid receptor 1 isoform a {Homo sapiens}
MKSILDGLADTTFRTITTDLLYVGSNDIQYEDIKGDMASKLGYFPQKFPLTSFRGSPFQEKMT
AGDNPQLVPADQVNITEFYNKSLSSFKENEENIQCGENFMDIECFMVLNPSQQLAIAVLSLTL
GTFTVLENLLVLCVILHSRSLRCRPSYHFIGSLAVADLLGSVIFVYSFIDFHVFHRKDSRNVFLF
KLGGVTASFTASVGSLFLTAIDRYISIHRPLAYKRIVTRPKAVVAFCLMWTIAIVIAVLPLLGW
NCEKLQSVCSDIFPHIDETYLMFWIGVTSVLLLFIVYAYMYILWKAHSHAVRMIQRGTQKSIII
HTSEDGKVQVTRPDQARMDIRLAKTLVLILVVLIICWGPLLAIMVYDVFGKMNKLIKTVFAF
CSMLCLLNSTVNPIIYALRSKDLRHAFRSMFPSCEGTAQPLDNSMGDSDCLHKHANNAASVH
RAAESCIKSTVKIAKVTMSVSTDTSAEAL
(SEQ ID NO: 1193)

TABLE 4-continued

Targets from which the Analogs are derived

>gi|38788193|ref|NP_005217.2|sphingosine-1-phosphate receptor 3 {Homo sapiens}
MATALPPRLQPVRGNETLREHYQYVGKLAGRLKEASEGSTLTTVLFLVICSFIVLENLMVLIA
IWKNNKFHNRMYFFIGNLALCDLLAGIAYKVNILMSGKKTFSLSPTVWFLREGSMFVALGAS
TCSLLAIAIERHLTMIKMRPYDANKRHRVFLLIGMCWLIAFTLGALPILGWNCLHNLPDCSTIL
PLYSKKYIAFCISIFTAILVTIVILYARIYFLVKSSSRKVANHNNSERSMALLRTVVIVVSVFIAC
WSPLFILFLIDVACRVQACPILFKAQWFIVLAVLNSAMNPVIYTLASKEMRRAFFRLVCNCLV
RGRGARASPIQPALDPSRSKSSSSNNSSHSPKVKEDLPHTAPSSCIMDKNAALQNGIFCN
(SEQ ID NO: 1194)

>gi|39725940|ref|NP_000903.2|kappa-type opioid receptor {Homo sapiens}
MDSPIQIFRGEPGPTCAPSACLPPNSSAWFPGWAEPDSNGSAGSEDAQLEPAHISPAIPVIITAV
YSVVFVVGLVGNSLVMFVIIRYTKMKTATNIYIFNLALADALVTTTMPFQSTVYLMNSWPFG
DVLCKIVISIDYYNMFTSIFTLTMMSVDRYIAVCHPVKALDFRTPLKAKIINICIWLLSSSVGIS
AIVLGGTKVREDVDVIECSLQFPDDDYSWWDLFMKICVFIFAFVIPVLIIIVCYTLMILRLKSV
RLLSGSREKDRNLRRITRLVLVVVAVFVVCWTPIHIFILVEALGSTSHSTAALSSYYFCIALGY
TNSSLNPILYAFLDENFKRCFRDFCFPLKMRMERQSTSRVRNTVQDPAYLRDIDGMNKPV
(SEQ ID NO: 1195)

>gi|40217829|ref|NP_003476.2|ovarian cancer G-protein coupled receptor 1 {Homo sapiens}
MRSVAPSGPKMGNITADNSSMSCTIDHTIHQTLAPVVYVTVLVVGFPANCLSLYFGYLQIKA
RNELGVYLCNLTVADLFYICSLPFWLQYVLQHDNWSHGDLSCQVCGILLYENIYISVGFLCCI
SVDRYLAVAHPFRFHQFRTLKAAVGSVVIWAKELLTSIYFLMHEEVIEDENQHRVCFENYPI
QAWQRAINYYRFLVGFLFPICLLLASYQGILRAVRRSHGTQKSRKDQIQRLVLSTVVIFLACF
LPYHVLLLVRSVWEASCDFAKGVFNAYHFSLLLTSFNCVADPVLYCFVSETTHRDLARLRGA
CLAFLTCSRTGRAREAYPLGAPEASGKSGAQGEEPELLTKLHPAFQTPNSPGSGGFPTGRLA
(SEQ ID NO: 1196)

>gi|40217833|ref|NP_061123.3|G-protein coupled receptor family C group 5 member C isoform b
{Homo sapiens}
MGTQPEPGLGARMAIHKALVMCLGLPLFLFPGAWAQGHVPPGCSQGLNPLYYNLCDRSGA
WGIVLEAVAGAGIVTTFVLTIILVASLPFVQDTKKRSLLGTQVFFLLGTLGLFCLVFACVVKP
DFSTCASRRFLFGVLFAICFSCLAAHVFALNFLARKNHGPRGWVIFTVALLLTLVEVIINTEWL
IITLVRGSGEGGPQGNSSAGWAVASPCAIANMDFVMALIYVMLLLLGAFLGAWPALCGRYK
RWRKHGVFVLLTTATSVAIWVVWIVMYTYGNKQHNSPTWDDPTLAIALAANAWAFVLFYV
IPEVSQVTKSSPEQSYQGDMYPTRGVGYETILKEQKGQSMFVENKAFSMDEPVAAKRPVSPY
SGYNGQLLTSVYQPTEMALMHKVPSEGAYDIILPRATANSQVMGSANSTLRAEDMYSAQSH
QAATPPKDGKNSQVFRNPYVWD
(SEQ ID NO: 1197)

>gi|40255245|ref|NP_005449.5|gamma-aminobutyric acid type B receptor subunit 2 precursor
{Homo sapiens}
MASPRSSGQPGPPPPPPPPARLLLLLLLPLLLPLAPGAWGWARGAPRPPPSSPPLSIMGLMPL
TKEVAKGSIGRGVLPAVELAIEQIRNESLLRPYFLDLRLYDTECDNAKGLKAFYDAIKYGPNH
LMVFGGVCPSVTSIIAESLQGWNLVQLSFAATTPVLADKKKYPYFFRTVPSDNAVNPAILKLL
KHYQWKRVGTLTQDVQRFSEVRNDLTGVLYGEDIEISDTESFSNDPCTSVKKLKGNDVRIIL
GQFDQNMAAKVFCCAYEENMYGSKYQWIIPGWYEPSWWEQVHTEANSSRCLRKNLLAAM
EGYIGVDFEPLSSKQIKTISGKTPQQYEREYNNKRSGVGPSKFHGYAYDGIWVIAKTLQRAM
ETLHASSRHQRIQDFNYTDHTLGRIILNAMNETNFFGVTGQVVFRNGERMGTIKFTQFQDSRE
VKVGEYNAVADTLEIINDTIRFQGSEPPKDKTIILEQLRKISLPLYSILSALTILGMIMASAFLFF
NIKNRNQKLIKMSSPYMNNLIILGGMLSYASIFLFGLDGSFVSEKTFETLCTVRTWILTVGYTT
AFGAMFAKTWRVHAIFKNVKMKKKIIKDQKLLVIVGGMLLIDLCILICWQAVDPLRRTVEKY
SMEPDPAGRDISIRPLLEHCENTHMTIWLGIVYAYKGLLMLFGCFLAWETRNVSIPALNDSKY
IGMSVYNVGIMCIIGAAVSFLTRDQPNVQFCIVALVIIFCSTITLCLVFVPKLITLRTNPDAATQ
NRRFQFTQNQKKEDSKTSTSVTSVNQASTSRLEGLQSENHRLRMKITELDKDLEEVTMQLQD
TPEKTTYIKQNHYQELNDILNLGNFTESTDGGKAILKNHLDQNPQLQWNTTEPSRTCKDPIED
INSPEHIQRRLSLQLPILHHAYLPSIGGVDASCVSPCVSPTASPRHRHVPPSFRVMVSGL
(SEQ ID NO: 1198)

>gi|40385873|ref|NP_954713.1|G protein-coupled receptor 150 {Homo sapiens}
MEDLFSPSILPPAPNISVPILLGWGLNLTLGQGAPASGPPSRRVRLVFLGVILVVAVAGNTTVL
CRLCGGGGPWAGPKRRKMDFLLVQLALADLYACGGTALSQLAWELLGEPRAATGDLACRF
LQLLQASGRGASAHLVVLIALERRRAVRLPHGRPLPARALAALGWLLALLLALPPAFVVRGD
SPSPLPPPPPPTSLQPGAPPAARAWPGERRCHGIFAPLPRWHLQVYAFYEAVAGFVAPVTVLG
VACGHLLSVWWRHRPQAPAAAAPWSASPGRAPAPSALPRAKVQSLKMSLLLALLFVGCELP
YFAARLAAAWSSGPAGDWEGEGLSAALRVVAMANSALNPFVYLFFQAGDCRLRRQLRKRL
GSLCCAPQGGAEDEEGPRGHQALYRQRWPHPHYHHARREPLDEGGLRPPPPRPRPLPCSCES
AF
(SEQ ID NO: 1199)

>gi|40807489|ref|NP_001965.3|EGF-like module-containing mucin-like hormone receptor-like 1
precursor {Homo sapiens}
MRGFNLLLFWGCCVMHSWEGHIRPTRKPNTKGNNCRDSTLCPAYATCTNTVDSYYCACKQ
GFLSSNGQNHFKDPGVRCKDIDECSQSPQPCGPNSSCKNLSGRYKCSCLDGFSSPTGNDWVP
GKPGNFSCTDINECLTSSVCPEHSDCVNSMGSYSCSCQVGFISRNSTCEDVDECADPRACPEH
ATCNNTVGNYSCFCNPGFESSSGHLSFQGLKASCEDIDECTEMCPINSTCTNTPGSYFCTCHP
GFAPSNGQLNFTDQGVECRDIDECRQDPSTCGPNSICTNALGSYSCGCIAGHPNPEGSQKDG
NFSCQRVLFKCKEDVIPDNKQIQQCQEGTAVKPAYVSFCAQINNIFSVLDKVCENKTTVVSLK TABLE 4-continued Targets from which the Analogs are derived NTTESFVPVLKQISTWTKFTKEETSSLATVFLESVESMTLASFWKPSANITPAVRTEYLDIESK
VINKECSEENVTLDLVAKGDKMKIGCSTIEESESTETTGVAFVSFVGMESVLNERFFKDHQAP
LTTSEIKLKMNSRVVGGIMTGEKKDGFSDPIIYTLENIQPKQKFERPICVSWSTDVKGGRWTS
FGCVILEASETYTICSCNQMANLAVIMASGELTMDFSLYIISHVGIIISLVCLVLAIATFLLCRSI
RNHNTYLHLHLCVCLLLAKTLFLAGIHKTDNKMGCAIIAGFLHYLFLACFFWMLVEAVILFL
MVRNLKVVNYFSSRNIKMLHICAFGYGLPMLVVVISASVQPQGYGMHNRCWLNTETGFIWS
FLGPVCTVIVINSLLLTWTLWILRQRLSSVNAEVSTLKDTRLLTFKAFAQLFILGCSWVLGIFQI
GPVAGVMAYLFTIINSLQGAFIFLIHCLLNGQVREEYKRWITGKTKPSSQSQTSRILLSSMPSA
SKTG
(SEQ ID NO: 1200)

>gi|41281557|ref|NP_055736.2|latrophilin-1 isoform 2 precursor {Homo sapiens}
MARLAAVLWNLCVTAVLVTSATQGLSRAGLPFGLMRRELACEGYPIELRCPGSDVIMVENA
NYGRTDDKICDADPFQMENVQCYLPDAFKIMSQRCNNRTQCVVVAGSDAFDPCPGTYKYL
EVQYDCVPYIFVCPGTLQKVLEPTSTHESEHQSGAWCKDPLQAGDRIYVMPWIPYRTDTLTE
YASWEDYVAARHTTTYRLPNRVDGTGFVVVYDGAVFYNKERTRNIVKYDLRTRIKSGETVIN
TANYHDTSPYRWGGKTDIDLAVDENGLWVIYATEGNNGRLVVSQLNPYTLRFEGTWETGY
DKRSASNAFMVCGVLYVLRSVYVDDDSEAAGNRVDYAFNTNANREEPVSLTFPNPYQFISS
VDYNPRDNQLYVWNNYFVVRYSLEFGPPDPSAGPATSPPLSTTTTARPTPLTSTASPAATTPL
RRAPLTTHPVGAINQLGPDLPPATAPVPSTRRPPAPNLHVSPELFCEPREVRRVQWPATQQGM
LVERPCPKGTRGIASFQCLPALGLWNPRGPDLSNCTSPWVNQVAQKIKSGENAANIASELAR
HTRGSIYAGDVSSSVKLMEQLLDILDAQLQALRPIERESAGKNYNKMHKRERTCKDYIKAVV
ETVDNLLRPEALESWKDMNATEQVHTATMLLDVLEEGAFLLADNVREPARFLAAKENVVL
EVTVLNTEGQVQELVFPQEEYPRKNSIQLSAKTIKQNSRNGVVKVVFILYNNLGLFLSTENAT
VKLAGEAGPGGPGGASLVVNSQVIAASINKESSRVFLMDPVIFTVAHLEDKNHFNANCSFWN
YSERSMLGYWSTQGCRLVESNKTHTTCACSHLTNFAVLMAHREIYQGRINELLLSVITWVGI
VISLVCLAICISTFCFLRGLQTDRNTIHKNLCINLFLAELLFLVGIDKTQYEIACPIFAGLLHYFF
LAAFSWLCLEGVHLYLLLVEVFESEYSRTKYYYLGGYCFPALVVGIAAAIDYRSYGTEKAC
WLRVDNYFIWSFIGPVSFVIVVNLVFLMVTLHKMIRSSSVLKPDSSRLDNIKSWALGAIALLF
LLGLTWAFGLLFINKESVVMAYLFTTFNAFQGVFIFVFHCALQKKVHKEYSKCLRHSYCCIRS
PPGGTHGSLKTSAMRSNTRYYTGTQSRIRRMWNDTVRKQTESSFMAGDINSTPTLNRGTMG
NHLLTNPVLQPRGGTSPYNTLIAESVGFNPSSPPVFNSPGSYREPKHPLGGREACGMDTLPLN
GNFNNSYSLRSGDFPPGDGGPEPPRGRNLADAAAFEKMIISELVHNNLRGSSSAAKGPPPPEP
PVPPVPGGGEEEAGGPGGADRAEIELLYKALEEPLLLPRAQSVLYQSDLDESESCTAEDGAT
SRPLSSPPGRDSLYASGANLRDSPYPDSSPEGPSEALPPPPPAPPGPPEIYYTSRPPALVARNPL
QGYYQVRRPSHEGYLAAPGLEGPGPDGDGQMQLVTSL
(SEQ ID NO: 1201)

>gi|41584200|ref|NP_005673.3|G-protein coupled receptor 56 isoform a precursor {Homo sapiens}
MTPQSLLQTTLFLLSLLFLVQGAHGRGHREDFRFCSQRNQTHRSSLHYKPTPDLRISIENSEEA
LTVHAPFPAAHPASRSFPDPRGLYHFCLYWNRHAGRLHLLYGKRDFLLSDKASSLLCFQHQE
ESLAQGPPLLATSVTSWWSPQNISLPSAASFTFSFHSPPHTAAHNASVDMCELKRDLQLLSQF
LKHPQKASRRPSAAPASQQLQSLESKLTSVRFMGDMVSFEEDRINATVWKLQPTAGLQDLHI
HSRQEEEQSEIMEYSVLLPRTLFQRTKGRSGEAEKRLLLVDPSSQALFQDKNSSQVLGEKVLG
IVVQQNTKVANLTEPVVLTFQHQLQPKNVTLQCVFWVEDPTLSSPGHWSSAGCETVRRETQTS
CFCNHLTYFAVLMVSSVEVDAVHKHYLSLLSYVGCVVSALACLVTIAAYLCSRVPLPCRRKP
RDYTIKVHMNLLLAVFLLDTSFLLSEPVALTGSEAGCRASAIFLHFSLLTCLSWMGLEGYNLY
RLVVEVFGTYVPGYLLKLSAMGWGFPIFLVTLVALVDVDNYGPIILAVHRTPEGVIYPSMCW
IRDSLVSYITNLGLFSLVFLFNMAMLATMVVQILRLRPHTQKWSHVLTLLGLSLVLGLPWALI
FFSFASGTFQLVVLYLFSIITSFQGFLIFIWYWSMRLQARGGPSPLKSNSDSARLPISSGSTSSSRI
(SEQ ID NO: 1202)

>gi|42794265|ref|NP_944605.2|mas-related G-protein coupled receptor member D {Homo sapiens}
MNQTLNSSGTVESALNYSRGSTVHTAYLVLSSLAMFTCLCGMAGNSMVIWLLGFRMHRNPF
CIYILNLAAADLLFLFSMASTLSLETQPLVNTTDKVHELMKRLMYFAYTVGLSLLTAISTQRC
LSVLFPIWFKCHRPRHLSAWVCGLLWTLCLLMNGLTSSFCSKFLKFNEDRCFRVDMVQAALI
MGVLTPVMTLSSLTLFVWVRRSSQQWRRQPTRLFVVVLASVLVFLICSLPLSIYWFVLYWLS
LPPEMQVLCFSLSRLSSSVSSSANPVIYFLVGSRRHLPTRSLGTVLQQALREEPELEGGETPT
VGTNEMGA
(SEQ ID NO: 1203)

>gi|42822887|ref|NP_002027.2|Duffy blood group antigen isoform b {Homo sapiens}
MGNCLHRAELSPSTENSSQLDFEDVWNSSYGVNDSFPDGDYGANLEAAAPCHSCNLLDDSA
LPFFILTSVLGILASSTVLFMLFRPLFRWQLCPGWPVLAQLAVGSALFSIVVPVLAPGLGSTRS
SALCSLGYCVWYGSAFAQALLLGCHASLGHRLGAGQVPGLTLGLTVGIWGVAALLTLPVTL
ASGASGGLCTLIYSTELKALQATHTVACLAIFVLLPLGLFGAKGLKKALGMGPGPWMNILW
AWFIFWWPHGVVLGLDPFLVRSKLLLLSTCLAQQALDLLLNLAEALAILHCVATPLLLALFCH
QATRTLLPSLPLPEGWSSHLDTLGSKS
(SEQ ID NO: 1204)

>gi|45433552|ref|NP_942122.2|probable G-protein coupled receptor 133 precursor {Homo sapiens}
MEKLLRLCCWYSWLLLFYYNFQVRGVYSRSQDHPGFQVLASASHYWPLENVDGIHELQDT
TGDIVEGKVNKGIYLKEEKGVTLLYYGRYNSSCISKPEQCGPEGVTFSFFWKTQGEQSRPIPS
AYGGQVISNGFKVCSSGGRGSVELYTRDNSMTWEASFSPPGPYWTHVLFTWKSKEGLKVYV
NGTLSTSDPSGKVSRDYGESNVNLVIGSEQDQAKCYENGAFDEFIIWERALTPDEIAMYFTAA
IGKHALLSSTLPSLFMTSTASPVMPTDAYHPIITNLTEERKTFQSPGVILSYLQNVSLSLPSKSLS
EQTALNLTKTFLKAVGEILLLPGWIALSEDSAVVLSLIDTIDTVMGHVSSNLHGSTPQVTVEG
SSAMAEFSVAKILPKTVNSSHYRFPAHGQSFIQIPHEAFHRHAWSTVVGLLYHSMHYYLNNI TABLE 4-continued Targets from which the Analogs are derived WPAHTKIAEAMHHQDCLLFATSHLISLEVSPPPTLSQNLSGSPLITVHLKHRLTRKQHSEATNS
SNRVFVYCAFLDFSSGEGVWSNHGCALTRGNLTYSVCRCTHLTNFAILMQVVPLELARGHQ
VALSSISYVGCSLSVLCLVATLVTFAVLSSVSTIRNQRYHIHANLSFAVLVAQVLLLISFRLEP
GTTPCQVMAVLLHYFFLSAFAWMLVEGLHLYSMVIKVFGSEDSKHRYYYGMGWGFPLLICI
ISLSFAMDSYGTSNNCWLSLASGAIWAFVAPALFVIVVNIGILIAVTRVISQISADNYKIHGDPS
AFKLTAKAVAVLLPILGTSWVFGVLAVNGCAVVFQYMFATLNSLQGLFIFLFHCLLNSEVRA
AFKHKTKVWSLTSSSARTSNAKPFHSDLMNGTRPGMASTKLSPWDKSSHSAHRVDLSAV
(SEQ ID NO: 1205)

>gi|46243671|ref|NP_996880.1|G protein-coupled receptor 152 {Homo sapiens}
MDTTMEADLGATGHRPRTELDDEDSYPQGGWDTVFLVALLLGLPANGLMAWLAGSQAR
HGAGTRLALLLLSLALSDFLFLAAAAFQILEIRHGGHWPLGTAACRFYYFLWGVSYSSGLFLL
AALSLDRCLLALCPHWYPGHRPVRLPLWVCAGVWVLATLFSVPWLVFPEAAVWWYDLVIC
LDFWDSEELSLRMLEVLGGFLPFLLLLVCHVLTQATACRTCHRQQQPAACRGFARVARTILS
AYVVLRLPYQLAQLLYLAFLWDVYSGYLLWEALVYSDYLILLNSCLSPFLCLMASADLRTLL
RSVLSSFAAALCEERPGSFTPTEPQTQLDSEGPTLPEPMAEAQSQMDPVAQPQVNPTLQPRSD
PTAQPQLNPTAQPQSDPTAQPQLNLMAQPQSDSVAQPQADTNVQTPAPAASSVPSPCDEASP
TPSSHPTPGALEDPATPPASEGESPSSTPPEAAPGAGPT
(SEQ ID NO: 1206)

>gi|46358417|ref|NP_000831.2|metabotropic glutamate receptor 3 precursor {Homo sapiens}
MKMLTRLQVLTLALFSKGFLLSLGDHNFLRREIKIEGDLVLGGLFPINEKGTGTEECGRINED
RGIQRLEAMLFAIDEINKDDYLLPGVKLGVHILDTCSRDTYALEQSLEFVRASLTKVDEAEY
MCPDGSYAIQENIPLLIAGVIGGSYSSVSIQVANLLRLFQIPQISYASTSAKLSDKSRYDYFART
VPPDFYQAKAMAEILRFFNWTYVSTVASEGDYGETGIEAFEQEARLRNICIATAEKVGRSNIR
KSYDSVIRELLQKPNARVVVLFMRSDDSRELIAAASRANASFTWVASDGWGAQESIIKGSEH
VAYGAITLELASQPVRQFDRYFQSLNPYNNHRNPWFRDFWEQKFQCSLQNKRNHRRVCDK
HLAIDSSNYEQESKIMFVVNAVYAMAHALHKMQRTLCPNTTKLCDAMKILDGKKLYKDYL
LKINFTAPFNPNKDADSIVKFDTFGDGMGRYNVFNFQNVGGKYSYLKVGHWAETLSLDVNS
IHWSRNSVPTSQCSDPCAPNEMKNMQPGDVCCWICIPCEPYEYLADEFTCMDCGSGQWPTA
DLTGCYDLPEDYIRWEDAWAIGPVTIACLGFMCTCMVVTVFIKHNNTPLVKASGRELCYILL
FGVGLSYCMTFFFIAKPSPVICALRRLGLGSSFAICYSALLTKTNCIARIFDGVKNGAQRPKFIS
PSSQVFICLGLILVQIVMVSVWLILEAPGTRRYTLAEKRETVILKCNVKDSSMLISLTYDVILVI
LCTVYAFKTRKCPENFNEAKFIGFTMYTTCIIWLAFLPIFYVTSSDYRVQTTTMCISVSLSGFV
VLGCLFAPKVHIILFQPQKNVVTHRLHLNRFSVSGTGTTYSQSSASTYVPTVCNGREVLDSTT
SSL
(SEQ ID NO: 1207)

>gi|46395496|ref|NP_997055.1|neuropeptide S receptor isoform A {Homo sapiens}
MPANFTEGSFDSSGTGQTLDSSPVACTETVTFTEVVEGKEWGSFYYSFKTEQLITLWVLFVFT
IVGNSVVLFSTWRRKKKSRMTFFVTQLAITDSFTGLVNILTDINWRFTGDFTAPDLVCRVVRY
LQVVLLYASTYVLVSLSIDRYHAIVYPMKFLQGEKQARVLIVIAWSLSFLFSIPTLIIFGKRTLS
NGEVQCWALWPDDSYWTPYMTIVAFLVYFIPLTIISIMYGIVIRTIWIKSKTYETVISNCSDGK
LCSSYNRGLISKAKIKAIKYSIIIILAFICCWSPYFLFDILDNFNLLPDTQERFYASVIIQNLPALN
SAINPLIYCVFSSSISFPCREQRSQDSRMTFRERTERHEMQILSKPEFI
(SEQ ID NO: 1208)

>gi|47271392|ref|NP_149039.2|succinate receptor 1 {Homo sapiens}
MLGIMAWNATCKNWLAAEEAALEKYYLSIFYGIEFVVGVLGNTIVVYGYIFSLKNWNSSNIYL
FNLSVSDLAFLCTLPMLIRSYANGNWIYGDVLCISNRYVLHANLYTSILFLTFISIDRYLIIKYPF
REHLLQKKEFAILISLAIWVLTLELLPILPLINPVITDNGTTCNDPASSGDPNYNLIYSMCLTL
LGFLIPLFVMCFFYYKIALFLKQRNRQVATALPLEKPLNLVIMAVVIFSVLFTPYHVMRNVRI
ASRLGSWKQYQCTQVVINSFYIVTRPLAFLNSVINPVFYFLLGDHFRDMLMNQLRHNFKSLT
SFSRWAHELLLSFREK
(SEQ ID NO: 1209)

>gi|50897278|ref|NP_001002911.1|probable G-protein coupled receptor 139 {Homo sapiens}
MEHTAHLAANSSLSWWSPGSACGLGFVPVVYYSLLLCLGLPANILTVIILSQLVARRQKSS
YNYLLALAAADILVLFFIVFVDFLLEDFILNMQMPQVPDKIVTCSSIHTSIWITVPLTIDRYI
AVCHPLKYHTVSYPARTRKVIVSVYITCFLTSIPYYWWPNIWTEDYISTSVHHVLIWIHCFTV
YLVPCSIFFILNSIIVYKLRRKSNFRLRGYSTGKTTAILFTITSIFATLWAPRIIMILYHLYGAPIQ
NRWLVHIMSDIANMLALLNTAINFFLYCFISKRFRTMAAATLKAFFKCQKQPVQFYTNHNFSI
TSSPWISPANSHCIKMLVYQYDKNGKPIKVSP
(SEQ ID NO: 1210)

>gi|52426748|ref|NP_000732.2|cholinergic receptor, muscarinic 4 {Homo sapiens}
MANFTPVNGSSGNQSVRLVTSSSHNRYETVEMVFIATVTGSLSLVTVVGNILVMLSIKVNRQ
LQTVNNYFLFSLACADLIIGAFSMNLYTVYIIKGYWPLGAVVCDLWLALDYVVSNASVMNL
LIISFDRYFCVTKPLTYPARRTTKMAGLMIAAAWVLSFVLWAPAILFWQFVVGKRTVPDNQC
FIQFLSNPAVTFGTAIAAFYLPVVIMTVLYIHISLASRSRVHKHRPEKKEKKAKTLAFLKSPL
MKQSVKKPPPGEAAREELRNGKLEEAPPPALPPPPRPVADKDTSNESSSGSATQNTKERPATE
LSTTEATTPAMPAPPLQPPRALNPASRWSKIQIVTKQTGNECVTAIEIVPATPAGMRPAANVAR
KFASIARNQVRKKRQMAARERKVTRTIFAILLAFILTWTPYNVMVLVNTFCQSCIPDTVWSIG
YWLCYVNSTINPACYALCNATFKKTFRHLLLCQYRNIGTAR
(SEQ ID NO: 1211)

TABLE 4-continued

Targets from which the Analogs are derived

>gi|52426789|ref|NP_543008.3|2-oxoglutarate receptor 1 {Homo sapiens}
MNEPLDYLANASDFPDYAAAFGNCTDENIPLKMHYLPVIYGIIFLVGFPGNAVVISTYIFKMR
PWKSSTIIMLNLACTDLLYLTSLPFLIHYYASGENWIFGDFMCKFIRFSFHFNLYSSILFLTCFSI
FRYCVIIHPMSCFSIHKTRCAVVACAVVWIISLVAVIPMTFLITSTNRTNRSACLDLTSSDELNT
IKWYNLILTATTFCLPLVIVTLCYTTIIHTLTHGLQTDSCLKQKARRLTILLLLAFYVCFLPFHIL
RVIRIESRLLSISCSIENQIHEAYIVSRPLAALNTFGNLLLYVVVSDNFQQAVCSTVRCKVSGNL
EQAKKISYSNNP
(SEQ ID NO: 1212)

>gi|53828924|ref|NP_005276.2|neuropeptides B/W receptor type 1 {Homo sapiens}
MDNASFSEPWPANASGPDPALSCSNASTLAPLPAPLAVAVPVVYAVICAVGLAGNSAVLYV
LLRAPRMKTVTNLFILNLAIADELFTLVLPINIADFLLRQWPFGELMCKLIVAIDQYNTFSSLY
FLTVMSADRYLVVLATAESRRVAGRTYSAARAVSLAVWGIVTLVVLPFAVFARLDDEQGRR
QCVLVFPQPEAFWWRASRLYTLVLGFAIPVSTICVLYTTLLCRLHAMRLDSHAKALERAKKR
VTFLVVAILAVCLLCWTPYHLSTVVALTTDLPQTPLVIAISYFITSLSYANSCLNPFLYAFLDA
SFRRNLRQLITCRAAA
(SEQ ID NO: 1213)

>gi|55953085|ref|NP_859529.2|G-protein coupled receptor 120 {Homo sapiens}
MSPECARAAGDAPLRSLEQANRTRFPFFSDVKGDHRLVLAAVETTVLVLIFAVSLLGNVCAL
VLVARRRRGATACLVLNLFCADLLFISAIPLVLAVRWTEAWLLGPVACHLLFYVMTLSGSV
TILTLAAVSLERMVCIVHLQRGVRGPGRRARAVLLALIWGYSAVAALPLCVFFRVVPQRLPG
ADQEISICTLIWPTIPGEISWDVSFVTLNFLVPGLVIVISYSKILQTSEHLLDARAVVTHSEITKA
SRKRLTVSLAYSESHQIRVSQQDFRLFRTLFLLMVSFFIMWSPIIITILLILIQNFKQDLVIWPSLF
FWVVAFTFANSALNPILYNMTLCRNEWKKIFCCFWFPEKGAILTDTSVKRNDLSIISG
(SEQ ID NO: 1214)

>gi|55956923|ref|NP_000515.2|5-hydroxytryptamine receptor 1A {Homo sapiens}
MDVLSPGQGNNTTSPPAPFETGGNTTGISDVTVSYQVITSLLLGTLIFCAVLGNACVVAAIAL
ERSLQNVANYLIGSLAVTDLMVSVLVLPMAALYQVLNKWTLGQVTCDLFIALDVLCCTSSIL
HLCAIALDRYWAITDPIDYVNKRTPRRAAALISLTWLIGFLISIPPMLGWRTPEDRSDPDACTIS
KDHGYTIYSTFGAFYIPLLLMLVLYGRIFRAARFRIRKTVKKVEKTGADTRHGASPAPQPKKS
VNGESGSRNWRLGVESKAGGALCANGAVRQGDDGAALEVIEVHRVGNSKEHLPLPSEAGPT
PCAPASFERKNERNAEAKRKMALARERKTVKTLGIIMGTFILCWLPFFIVALVLPFCESSCHM
PTLLGAIINWLGYSNSLLNPVIYAYFNKDFQNAFKKIIKCKFCRQ
(SEQ ID NO: 1215)

>gi|57165355|ref|NP_001008701.1|latrophilin-1 isoform 1 precursor {Homo sapiens}
MARLAAVLWNLCVTAVLVTSATQGLSRAGLPFGLMRRELACEGYPIELRCPGSDVIMVENA
NYGRTDDKICDADPFQMENVQCYLPDAFKIMSQRCNNRTQCVVVAGSDAFPDPCPGTYKYL
EVQYDCVPYKVEQKVFVCPGTLQKVLEPTSTHESEHQSGAWCKDPLQAGDRIYVMPWIPYR
TDTLTEYASWEDYVAARHTTTYRLPNRVDGTGFVVYDGAVFYNKERTRNIVKYDLRTRIKS
GETVINTANYHDTSPYRWGGKTDIDLAVDENGLWVIYATEGNNGRLVVSQLNPYTLRFEGT
WETGYDKRSASNAFMVCGVLYVLRSVYVDDDSEAAGNRVDYAFNTNANREEPVSLTFPNP
YQFISSVDYNPRDNQLYVWNNYFVVRYSLEFGPPDPSAGPATSPPLSTTTTARPTPLTSTASPA
ATTPLRRAPLTTHPVGAINQLGPDLPPATAPVPSTRRPPAPNLHVSPELFCEPREVRRVQWPA
TQQGMLVERPCPKGTRGIASFQCLPALGLWNPRGPDLSNCTSPWVNQVAQKIKSGENAANIA
SELARHTRGSIYAGDVSSSVKLMEQLLDILDAQLQALRPIERESAGKNYNKMHKRERTCKDY
IKAVVETVDNLLRPEALESWKDMNATEQVHTATMLLDVLEEGAFLLADNVREPARFLAAKE
NVVLEVTVLNTEGQVQELVFPQEEYPRKNSIQLSAKTIKQNSRNGVVKVVFILYNNLGLFLST
ENATVKLAGEAGPGGPGGASLVVNSQVIAASINKESSRVFLMDPVIFTVAHLEDKNHFNANC
SFWNYSERSMLGYWSTQGCRLVESNKTHTTCACSHLTNFAVLMAHREIYQGRINELLLSVIT
WVGIVISLVCLAICISTFCFLRGLQTDRNTIHKNLCINLFLAELLFLVGIDKTQYEIACFIPAGLL
HYFFLAAFSWLCLEGVHLYLLLVEVFESEYSRTKYYYLGGYCFPALVVGIAAAIDYRSYGTE
KACWLRVDNYFIWSFIGPVSFVIVVNLVFLMVTLHKMIRSSSVLKPDSSRLDNIKSWALGAIA
LLFLLGLTWAFGLLFINKESVVMAYLFTTFNAFQGVFIFVHCALQKKVHKEYSKCLRHSYC
CIRSPPGGTHGSLKTSAMRSNTRYYTGTQSRIRRMWNDTVRKQTESSFMAGDINSTPTLNRG
TMGNHLLTNPVLQPRGGTSPYNTLIAESVGFNPSSPPVFNSPGSYREPKHPLGGREACGMDTL
PLNGNFNNSYSLRSGDFPPGDGGPEPPRGRNLADAAAFEKMIISELVHNNLRGSSSAAKGPPP
PEPPVPPVPGGGGEEEAGGPGGADRAEIELLYKALEEPLLLPRAQSVLYQSDLDESESCTAED
GATSRPLSSPPGRDSLYASGANLRDSPSYPDSSPEGPSEALPPPPPAPPGPPEIYYTSRPPALVA
RNPLQGYYQVRRPSHEGYLAAPGLEGPGPDGDGQMQLVTSL
(SEQ ID NO: 1216)

>gi|57165371|ref|NP_114142.3|probable G-protein coupled receptor 61 {Homo sapiens}
MESSPIPQSSGNSSTLGRVPQTPGPSTASGVPEVGLRDVASESVALFFMLLLDLTAVAGNAAV
MAVIAKTPALRKFVFVHLCLVDLLAALTLMPLAMLSSSALFDHALFGEVACRLYLFLSVCF
VSLAILSVSAINVERYYYVVHPMRYEVRMTLGLVASVLVGVWVKALAMASVPVLGRVSWE
EGAPSVPPGCSLQWSHSAYCQLFVVVFAVLYFLLPLLLILVVYCSMFRVARVAAMQHGPLPT
WMETPRQRSESLSSRSTMVTSSGAPQTTPHRTFGGGKAAVVLLAVGGQFLLCWLPYFSFHLY
VALSAQPISTGQVESVVTWIGYFCFTSNPFFYGCLNRQIRGELSKQPVCFFKPAPEEELRLPSR
EGSIEENFLQFLQGTGCPSESWVSRPLPSPKQEPPAVDFRIPGQIAEETSEFLEQQLTSDIIMSDS
YLRPAASPRLES
(SEQ ID NO: 1217)

TABLE 4-continued

Targets from which the Analogs are derived

>gi|57977305|ref|NP_919227.2|G protein-coupled receptor 151 {Homo sapiens}
MLAAAFADSNSSSMNVSFAHLHFAGGYLPSDSQDWRTIIPALLVAVCLVGFVGNLCVIGILL
HNAWKGKPSMIHSLILNLSLADLSLLLFSAPIRATAYSKSVWDLGWFVCKSSDWFIHTCMAA
KSLTIVVVAKVCFMYASDPAKQVSIHNYTIWSVLVAIWTVASLLPLPEWFFSTIRHHEGVEM
CLVDVPAVAEEFMSMFGKLYPLLAFGLPLFFASFYFWRAYDQCKKRGTKTQNLRNQIRSKQ
VTVMLLSIAIISALLWLPEWVAWLWVWHLKAAGPAPPQGFIALSQVLMFSISSANPLIFLVMS
EEFREGLKGVWKWMITKKPPTVSESQETPAGNSEGLPDKVPSPESPASIPEKEKPSSPSSGKGK
TEKAEIPILPDVEQFWHERDTVPSVQDNDPIPWEHEDQETGEGVK
(SEQ ID NO: 1218)

>gi|58530851|ref|NP_000814.2|growth hormone-releasing hormone receptor isoform a precursor
{Homo sapiens}
MDRRMWGAHVFCVLSPLPTVLGHMHPECDFITQLREDESACLQAAEEMPNTTLGCPATWD
GLLCWPTAGSGEWVTLPCPDFFSHFSSESGAVKRDCTITGWSEPFPPYPVACPVPLELLAEEE
SYFSTVKIIYTVGHSISIVALFVAITILVALRRLHCPRNYVHTQLFTTFILKAGAVFLKDAALFH
SDDTDHCSFSTVLCKVSVAASHFATMTNFSWLLAEAVYLNCLLASTSPSSRRAFWWLVLAG
WGLPVLFTGTWVSCKLAFEDIACWDLDDTSPYWWIIKGPIVLSVGVNFGLFLNIIRILVRKLE
PAQGSLHTQSQYWRLSKSTLFLIPLFGIHYIIFNFLPDNAGLGIRLPLELGLGSFQGFIVAILYCF
LNQEVRTEISRKWHGHDPELLPAWRTRAKWTTPSRSAAKVLTSMC
(SEQ ID NO: 1219)

>gi|59710093|ref|NP_722576.3|probable G-protein coupled receptor 112 {Homo sapiens}
MKEHIIYQKLYGLILMSSFIFLSDTLSLKGKKLDFFGRGDTYVSLIDTIPELSRFTACIDLVFMD
DNSRYWMAFSYITNNALLGREDIDLGLAGDHQQLILYRLGKTFSIRHHLASPQWHTICLIWD
GVKGKLELFLNKERILEVTDQPHNLTPHGTLFLGHFLKNESSEVKSMMRSFPGSLYYFQLWD
HILENEEFMKCLDGNIVSWEEDVWLVNKIIPTVDRTLRCFVPENMTIQEKSTTVSQQIDMTTP
SQITGVKPQNTAHSSTLLSQSIPIFATDYTTISYSNTTSPPLETMTAQKILKTLVDETATFAVDV
LSTSSAISLPTQSISIDNTTNSMKKTKSPSSESTKTTKMVEAMATEIFQPPTPSNFLSTSRFTKNS
VVSTTSAIKSQSAVTKTTSLFSTIESTSMSTTPCLKQKSTNTGALPISTAGQEFIESTAAGTVPW
FTVEKTSPASTHVGTASSFPPEPVLISTAAPVDSVFPRNQTAFPLATTDMKIAFTVHSLTLPTRL
IETTPAPRTAETELTSTNFQDVSLPRVEDAMSTSMSKETSSKTFSFLTSFSFTGTESVQTVIDAE
ATRTALTPEITLASTVAETMLSSTITGRVYTQNTPTADGHLLTLMSTRSASTSKAPESGPTSTT
DEAAHLFSSNETIWTSRPDQALLASMNTTTILTFVPNENFTSAFHENTTYTEYLSATTNITPLK
ASPEGKGTTANDATTARYTTAVSKLTSPWFANFSIVSGTTSITNMPEFKLTTLLLKTIPMSTKP
ANELPLTPRETVVPSVDIISTLACIQPNFSTEESASETTQTEINGAIVFGGTTTPVPKSATTQRLN
ATVTRKEATSHYLMRKSTIAAVAEVSPFSTMLEVTDESAQRVTASVTVSSFPDIEKLSTPLDN
KTATTEVRESWLLTKLVKTTPRSSYNEMTEMFNFNHTYVAHWTSETSEGISAGSPTSGSTHIF
GEPLGASTTRISETSFSTTPTDRTATSLSDGILPPQPTAAHSSATPVPVTHMFSLPVNGSSVVAE
ETEVTMSEPSTLARAFSTSVLSDVSNLSSTTMTTALVPPLDQTASTTIVIVPTHGDLIRTTSEAT
VISVRKTSMAVPSLTETPFHSLRLSTPVTAKAETTLFSTSVDTVTPSTHTLVCSKPPPDNIPPAS
STHVISTTSTPEATQPISQVEETSTYALSFPYTFSGGGVVASLATGTTETSVVDETTPSHISANK
LTTSVNSHISSSATYRVHTPVSIQLVTSTSVLSSDKDQMTISLGKTPRTMEVTEMSPSKNSFISY
SRGTPSLEMTDTGFPETTKISSHQTHSPSEIPLGTPSDGNLASSPTSGSTQITPTLTSSNTVGVHI
PEMSTSLGKTALPSQALTITTFLCPEKESTSALPAYTPRTVEMIVNSTYVTHSVSYGQDTSFVD
TTTSSSTRISNPMDINTTFSHLHSLRTQPEVTSVASFISESTQTFPESLSLSTAGLYNDGFTVLSD
RITTAFSVPNVPTMLPRESSMATSTPIYQMSSLPVNVTAFTSKKVSDTPPIVITKSSKTMHPGC
LKSPCTATSGPMSEMSSIPVNNSAFTPATVSSDTSTRVGLFSTLLSSVTPRTTMTMQTSTLDVT
PVIYAGATSKNKMVSSAFTTEMIEAPSRITPTTFLSPTEPTLPFVKTVPTTIMAGIVTPFVGTTA
FSPLSSKSTGAISSIPKTTFSPFLSATQQSSQADEATTLGILSGITNRSLSTVNSGTGVALTDTYS
RITVPENMLSPTHADSLHTSFNIQVSPSLTSFKSASGPTKNVKTTTNCFSSNTRKMTSLLEKTS
LTNYATSLNTPVSYPPWTPSSATLPSLTSFVYSPHSTEAEISTPKTSPPPTSQMVEFPVLGTRMT
SSNTQPLLMTSWNIPTAEGSQFPISTTINVPTSNEMETETLHLVPGPLSTFTASQTGLVSKDVM
AMSSIPMSGILPNHGLSENPSLSTSLRAITSTLADVKHTFEKMTTSVTPGTTLPSILSGATSGSVI
SKSPILTWLLSSLPSGSPPATVSNAPHVMTSSTVEVSKSTFLTSDMISAHPFTNLTTLPSATMST
ILTRTIPTPTLGGITTGFPTSLPMSINVTDDIVYISTHPEASSRTTITANPRTVSHPSSFSRKTMSP
STTDHTLSVGAMPLPSSTITSSWNRIPTASSPSTLIIPKPTLDSLLNIMTTTSTVPGASFPLISTGV
TYPFTATVSSPISSFFETTWLDSTPSFLSTEASTSPATKSTVSFYNVEMSFSVFVEEPRIPITSVI
NEFTENSLNSIFQNSEFSLATLETQIKSRDISEEEMVMDRAILEQREGQEMATISYVPYSCVCQ
VIIKASSSLASSELMRKIKSKIHGNFTHGNFTQDQLTLLVNCEHVAVKKLEPGNCKADETASK
YKGTYKWLLTNPTETAQTRCIKNEDGNATRFCSISINTGKSQWEKPKFKQCKLLQELPDLIV
DLANITISDENAEDVAEHILNLINESPALGKEETKIIVSKISDISQCDEISMNLTHVMLQIINVVL
EKQNNSASDLHEISNEILRIIERTGHKMEFSGQIANLTVAGLALAVLRGDHTFDGMAFSIHSYE
EGTDPEIFLGNVPVGGILASIYLPKSLTERIPLSNLQTILFNFFGQTSLFKTKNVTKALTTYVVS
ASISDDMFIQNLADPVVITLQHIGGNQNYGQVHCAFWDFENNNGLGGWNSSGCKVKETNVN
YTICQCDHLTHFGVLMDLSRSTVDSVNEQILALITYTGCGISSIFLGVAVVTYIAFHKLRKDYP
AKILINLCTALLMLNLVFLINSWLSSFQKVGVCITAAVALHYFLLVSFTWMGLEAVHMYLAL
VKVFNIYIPNYILKFCLVGWGIPAIMVAITVSVKKDLYGTLSPTTPFCWIKDDSIFYISVVAYFC
LIFLMNLSMFCTVLVQLNSVKSQIQKTRRKMILHDLKGTMSLTFLLGLTWGFAFFAWGPMR
NFFLYLFAIFNTLQGFFIFVFHCVMKESVREQWQIHLCCGWLRLDNSSDGSSRCQIKVGYKQE
GLKKIFEHKLLTPSLKSTATSSTFKSLGSAQGTPSEISFPNDDFDKDPYCSSP
(SEQ ID NO: 1220)

>gi|59823631|ref|NP_660333.2|probable G-protein coupled receptor 125 precursor {Homo sapiens}
MEPPGRRRGRAQPPLLLPLSLLALLALLGGGGGGAAALPAGCKHDGRPRGAGRAAGAAE
GKVVCSSLELAQVLPPDTLPNRTVTLILSNNKISELKNGSFSGLSLLERLDLRNNLISSIDPGAF
WGLSSLKRLDLTNNRIGCLNADIFRGLTNLVRLNLSGNLFSSLSQGTFDYLASLRSLEFQTEY
LLCDCNILWMHRWVKEKNITVRDTRCVYPKSLQAQPVTGVKQELLTCDPPLELPSFYMTPSH TABLE 4-continued Targets from which the Analogs are derived RQVVFEGDSLPFQCMASYIDQDMQVLWYQDGRIVETDESQGIFVEKNMIHNCSLIASALTISN
IQAGSTGNWGCHVQTKRGNNTRTVDIVVLESSAQYCPPERVVNNKGDFRWPRTLAGITAYL
QCTRNTHGSGIYPGNPQDERKAWRRCDRGGFWADDDYSRCQYANDVTRVLYMFNQMPLN
LTNAVATARQLLAYTVEAANFSDKMDVIFVAEMIEKFGRFTKEEKSKELGDVMVDIASNIML
ADERVLWLAQREAKACSRIVQCLQRIATYRLAGGAHVYSTYSPNIALEAYVIKSTGFTGMTC
TVFQKVAASDRTGLSDYGRRDPEGNLDKQLSFKCNVSNTFSSLALKNTIVEASIQLPPSLFSPK
QKRELRPTDDSLYKLQLIAFRNGKLFPATGNSTNLADDGKRRTVVTPVILTKIDGVNVDTHHI
PVNVTLRRIAHGADAVAARWDFDLLNGQGGWKSDGCHILYSDENITTIQCYSLSNYAVLMD
LTGSELYTQAASLLHPVVYTTAIILLLCLLAVIVSYIYHHSLIRISLKSWHMLVNLCFHIFLTCV
VFVGGITQTRNASICQAVGIILHYSTLATVLWVGVTARNIYKQVTKKAKRCQDPDEPPPPPRP
MLRFYLIGGGIPIIVCGITAAANIKNYGSRPNAPYCWMAWEPSLGAFYGPASFITFVNCMYFL
SIFIQLKRHPERKYELKEPTEEQQRLAANENGEINHQDSMSLSLISTSALENEHTFHSQLLGAS
LTLLLYVALWMFGALAVSLYYPLDLVFSFVFGATSLSFSAFFVVHHCVNREDVRLAWIMTC
CPGRSSYSVQVNVQPPNSNGTNGEAPKCPNSSAESSCTNKSASSFKNSSQGCKLTNLQAAAA
QCHANSLPLNSTPQLDNSLTEHSMDNDIKMHVAPLEVQFRTNVHSSRHHKNRSKGHRASRL
TVLREYAYDVPTSVEGSVQNGLPKSRLGNNEGHSRSRRAYLAYRERQYNPPQQDSSDACST
LPKSSRNFEKPVSTTSKKDALRKPAVVELENQQKSYGLNLAIQNGPIKSNGQEGPLLGTDSTG
NVRTGLWKHETTV
(SEQ ID NO: 1221)

>gi|61743940|ref|NP_722582.2|probable G-protein coupled receptor 110 isoform 1 {Homo sapiens}
MKVGVLWLISFFTFTDGHGGFLGKNDGIKTKKELIVNKKKHLGPVEEYQLLLQVTYRDSKE
KRDLRNFLKLLKPPLLWSHGLIRIIRAKATTDCNSLNGVLQCTCEDSYTWFPPSCLDPQNCYL
HTAGALPSCECHLNNLSQSVNFCERTKIWGTFKINERFTNDLLNSSSAIYSKYANGIEIQLKKA
YERIQGFESVQVTQFRNGSIVAGYEVVGSSSASELLSAIEHVAEKAKTALHKLFPLEDGSPRV
FGKAQCNDIVFGFGSKDDEYTLPCSSGYRGNITAKCESSGWQVIRETCVLSLLEELNKNFSMI
VGNATEAAVSSFVQNLSVIIRQNPSTTVGNLASVVSILSNISSLSLASHFRVSNSTMEDVISIAD
NILNSASVTNWTVLLREEKYASSRLLETLENISTLVPPTALPLNFSRKFIDWKGIPVNKSQLKR
GYSYQIKMCPQNTSIPIRGRVLIGSDQFQRSLPETIISMASLTLGNILPVSKNGNAQVNGPVIST
VIQNYSINEVFLFFSKIESNLSQPHCVFWDFSHLQWNDAGCHLVNETQDIVTCQCTHLTSFSIL
MSPFVPSTIFPVVKWITYVGLGISIGSLILCLIIEALFWKQIKKSQTSHTRRICMVNIALSLLIAD
VWFIVGATVDTTVNPSGVCTAAVFFTHFFYLSLFFWMLMLGILLAYRIILVFHHMAQHLMM
AVGFCLGYGCPLIISVITIAVTQPSNTYKRKDVCWLNWSNGSSKPLLAFVVPALAIVAVNFVVV
LLVLTKLWRPTVGERLSRDDKATIIRVGKSLLILTPLLGLTWGFGIGTIVDSQNLAWHVIFALL
NAFQGFFILCFGILLDSKLRQLLFNKLSALSSWKQTEKQNSSDLSAKPKFSKPFNPLQNKGHY
AFSHTGDSSDNIMLTQFVSNE
(SEQ ID NO: 1222)

>gi|62865887|ref|NP_115940.2|kiSS-1 receptor {Homo sapiens}
MHTVATSGPNASWGAPANASGCPGCGANASDPVPSPRAVDAWLVPLFFAALMLLGLVGN
SLVIYVICRHKPMRTVTNFYIANLAATDVTFLLCCVPFTALLYPLPGWVLGDFMCKFVNYIQ
QVSVQATCATLTAMSVDRWYVTVFPLRALHRRTPRLALAVSLSIWVGSAAVSAPVLALHRL
SPGPRAYCSEAFPSRALERAFALYNLLALYLLPLLATCACYAAMLRHLGRVAVRPAPADSAL
QGQVLAERAGAVRAKVSRLVAAVVLLFAACWGPIQLFLVLQALGPAGSWHPRSYAAYALK
TWAHCMSYSNSALNPLLYAFLGSHFRQAFRRVCPCAPRRPRRPRRPGPSDPAAPHAELLRLG
SHPAPARAQKPGSSGLAARGLCVLGEDNAPL
(SEQ ID NO: 1223)

>gi|62912472|ref|NP_067649.2|leucine-rich repeat-containing G protein-coupled receptor 6 isoform 2 {Homo sapiens}
MGRPRLTLVCQVSIIISARDLSMNNLTELQPGLFHHLRFLEELRLSGNHLSHIPGQAFSGLYSL
KILMLQNNQLGGIPAEALWELPSLQSLRLDANLISLVPERSFEGLSSLRHLWLDDNALTEIPVR
ALNNLPALQAMTLALNRISHIPDYAFQNLTSLVVLHLHNNRIQHLGTHSFEGLHNLETLDLN
YNKLQEFPVAIRTLGRLQELGFHNNNIKAIPEKAFMGNPLLQTIHHFYDNPIQFVGRSAFQYLPK
LHTLSLNGAMDIQEFPDLKGTTSLEILTLTRAGIRLLPSGMCQQLPRLRVLELSHNQIEELPSL
HRCQKLEEIGLQHNRIWEIGADTFSQLSSLQALDLSWNAIRSIHPEAFSTLHSLVKLDLTDNQL
TTLPLAGLGGLMHLKLKGNLALSQAFSKDSFPKLRILEVPYAYQCCPYGMCASFFKASGQW
EAEDLHLDDEESSKRPLGLLARQAENHYDQDLDELQLEMEDSKPHPSVQCSPTPGPFKPCEY
LFESWGIRLAVWAIVLLSVLCNGLVLLTVFAGGPVPLPPVKPVVGAIAGANTLTGISCGLLAS
VDALTFGQFSEYGARWETGLGCRATGFLAVLGSEASVLLLTLAAVQCSVSVSCVRAYGKSP
SLGSVRAGVLGCLALAGLAAALPLASVGEYGASPLCLPYAPPEGQPAALGFTVALVMMNSF
CFLVVAGAYIKLYCDLPRGDFEAVKDCAMVRHVAWLIFADGLLYCPVAFLSFASMLGLFPV
TPEAVKSVLLVVLPLPACLNPLLYLLFNPHFRDDLRRLRPRAGDSGPLAYAAAGELEKSSCDS
TQALVAFSDVDLILEASEAGRPPGLETYGFPSVTLISCQQPGAPRLEGSHCVEPEGNHFGNPQP
SMDGELLLRAEGSTPAGGGLSGGGGFQPSGLAFASHV
(SEQ ID NO: 1224)

>gi|63477962|ref|NP_000902.3|delta-type opioid receptor {Homo sapiens}
MEPAPSAGAELQPPLFANASDAYPSACPSAGANASGPPGARSASSLALAIAITALYSAVCAVG
LLGNVLVMFGIVRYTKMKTATNIYIFNLALADALATSTLPFQSAKYLMETWPFGELLCKAVL
SIDYYNMFTSIFTLTMMSVDRYIAVCHPVKALDFRTPAKAKLINICIWVLASGVGVPIMVMA
VTRPRDGAVVCMLQFPSPSWYWDTVTKICVFLFAFVVPILIITVCYGLMLLRLRSVRLLSGSK
EKDRSLRRITRMVLVVVGAFVVCWAPIHIFVIVWTLVDIDRRDPLVVAALHLCIALGYANSSL
NPVLYAFLDENFKRCFRQLCRKPCGRPDPSSFSRAREATARERVTACTPSDGPGGGAAA
(SEQ ID NO: 1225)

TABLE 4-continued

Targets from which the Analogs are derived

>gi|64085121|ref|NP_000360.2|thyroid stimulating hormone receptor isoform 1 precursor {Homo sapiens}
MRPADLLQLVLLLDLPRDLGGMGCSSPPCECHQEEDFRVTCKDIQRIPSLPPSTQTLKLIETHL
RTIPSHAFSNLPNISRIYVSIDVTLQQLESHSFYNLSKVTHIEIRNTRNLTYIDPDALKELPLLKF
LGIFNTGLKMFPDLTKVYSTDIFFILEITDNPYMTSIPVNAFQGLCNETLTLKLYNNGFTSVQG
YAFNGTKLDAVYLNKNKYLTVIDKDAFGGVYSGPSLLDVSQTSVTALPSKGLEHLKELIARN
TWTLKKLPLSLSFLHLTRADLSYPSHCCAFKNQKKIRGILESLMCNESSMQSLRQRKSVNALN
SPLHQEYEENLGDSIVGYKEKSKFQDTHNNAHYYVFFEEQEDEIIGFGQELKNPQEETLQAFD
SHYDYTICGDSEDMVCTPKSDEFNPCEDIMGYKFLRIVVWFVSLLALLGNVFVLLILLTSHYK
LNVPRFLMCNLAFADFCMGMYLLLIASVDLYTHSEYYNHAIDWQTGPGCNTAGFFTVFASE
LSVYTLTVITLERWYAITFAMRLDRKIRLRHACAIMVGGWVCCFLLALLPLVGISSYAKVSIC
LPMDTETPLALAYIVFVLTLNIVAFVIVCCCYVKIYITVRNPQYNPGDKDTKIAKRMAVLIFTD
FICMAPISFYALSAILNKPLITVSNSKILLVLFYPLNSCANPFLYAIFTKAFQRDVFILLSKFGICK
RQAQAYRGQRVPPKNSTDIQVQKVTHEMRQGLHNMEDVYELIENSHLTPKKQGQISEEYMQ
TVL
(SEQ ID NO: 1226)

>gi|66529100|ref|NP_000830.2|metabotropic glutamate receptor 2 isoform a precursor {Homo sapiens}
MGSLLALLALLLLWGAVAEGPAKKVLTLEGDLVLGGLFPVHQKGGPAEDCGPVNEHRGIQR
LEAMLFALDRINRDPHLLPGVRLGAHILDSCSKDTHALEQALDFVRASLSRGADGSRHICPDG
SYATHGDAPTAITGVIGGSYSDVSIQVANLLRLFQIPQISYASTSAKLSDKSRYDYFARTVPPD
FFQAKAMAEILRFFNWTYVSTVASEGDYGETGIEAFELEARARNICVATSEKVGRAMSRAAF
EGVVRALLQKPSARVAVLFTRSEDARELLAASQRLNASFTWVASDGWGALESVVAGSEGA
AEGAITIELASYPISDFASYFQSLDPWNNSRNPWFREFWEQRFRCSFRQRDCAAHSLRAVPFE
QESKIMFVVNAVYAMAHALHNMHRALCPNTTRLCDAMRPVNGRRLYKDFVLNVKFDAPFR
PADTHNEVRFDRFGDGIGRYNIFTYLRAGSGRYRYQKVGYWAEGLTLDTSLIPWASPSAGPL
PASRCSEPCLQNEVKSVQPGEVCCWLCIPCQPYEYRLDEFTCADCGLGYWPNASLTGCFELP
QEYIRWGDAWAVGPVTIACLGALATLFVLGVFVRHNATPVVKASGRELCYILLGGVFLCYC
MTFIFIAKPSTAVCTLRRLGLGTAFSVCYSALLTKTNRIARIFGGAREGAQRPRFISPASQVAIC
LALISGQLLIVVAWLVVEAPGTGKETAPERREVVTLRCNHRDASMLGSLAYNVLLIALCTLY
AFKTRKCPENFNEAKFIGFTMYTTCIIWLAFLPIFYVTSSDYRVQTTTMCVSVSLSGSVVLGCL
FAPKLHIILFQPQKNVVSHRAPTSRFGSAAARASSSLGQGSGSQFVPTVCNGREVVDSTTSSL
(SEQ ID NO: 1227)

>gi|68215224|ref|NP_003956.2|C-C chemokine receptor-like 2 isoform 1 {Homo sapiens}
MANYTLAPEDEYDVLIEGELESDEAEQCDKYDAQALSAQLVPSLCSAVFVIGVLDNLLVVLI
LVKYKGLKRVENIYLLNLAVSNLCFLLTLPFWAHAGGDPMCKILIGLYFVGLYSETFFNCLLT
VQRYLVFLHKGNFFSARRRVPCGIITSVLAWVTAILATLPEFVLVMPFSLANELMAYWYFGQ
LPADETFWKHFLTLKMNISVLVLPLFIFTFLYVQMRKTLRFREQRYSLFKLVFAIMVVFLLM
WAPYNIAFFLSTFKEHFSLSDCKSSYNLDKSVHITKLIATTHCCINPLLYAFLDGTFSKYLCRC
FHLRSNTPLQPRGQSAQGTSREEPDHSTEV
(SEQ ID NO: 1228)

>gi|71773208|ref|NP_000674.2|alpha-2C adrenergic receptor {Homo sapiens}
MASPALAAALAVAAAAGPNASGAGERGSGGVANASGASWGPPRGQYSAGAVAGLAAVVG
FLIVFTVVGNVLVVIAVLTSRALRAPQNLFLVSLASADILVATLVMPFSLANELMAYWYFGQ
VWCGVYLALDVLFCTSSIVHLCAISLDRYWSVTQAVEYNLKRTPRRVKATIVAVWLISAVIS
FPPLVSLYRQPDGAAYPQCGLNDETWYILSSCIGSFFAPCLIMGLVYARIVRVAKLRTRTLSE
KRAPVGPDGASPTTENGLGAAAGAGENGHCAPPPADVEPDESSAAAERRRRRGALRGGRR
RAGAEGGAGGADGQGAGPGAAESGALTASRSPGPGGRLSRASSRSVEFFLSRRRRARSSVCR
RKVAQAREKRFTFVLAVVMGVFVLCWFPFFFSYSLYGICREACQVPGPLFKFFFWIGYCNSS
LNPVIYTVFNQDFRRSFKHILFRRRRRGFRQ
(SEQ ID NO: 1229)

>gi|71999131|ref|NP_055137.2|opsin-3 {Homo sapiens}
MYSGNRSGGHGYWDGGGAAGAEGPAPAGTLSPAPLFSPGTYERLALLLGSIGLLGVNNLL
VLVLYYKFQRLRTPTHLLLVNISLSDLLVSLFGVTFTFVSCLRNGWVWDTVGCVWDGFSGSL
FGIVSIATLTVLAYERYIRVVHARVINFSWAWRAITYIWLYSLAWAGAPLLGWNRYILDVHG
LGCTVDWKSKDANDSSFVLFLFLGCLVVPLGVIAHCYGHILYSIRMLRCVEDLQTIQVIKILK
YEKKLAKMCFLMIFTFLVCWMPYIVICFLVVNGHGHLVTPTISIVSYLFAKSNTVYNPVIYVF
MIRKFRRSLLQLLCLRLLRCQRPAKDLPAAGSEMQIRPIVMSQKDGDRPKKKVTFNSSSIIFIIT
SDESLSVDDSDKTNGSKVDVIQVRPL
(SEQ ID NO: 1230)

>gi|74048357|ref|NP_065188.4|G-protein coupled receptor 126 alpha 1 precursor {Homo sapiens}
MMFRSDRMWSCHWKWKPSPLLFLFALYIMCVPHSVWGCANCRVVLSNPSGTFTSPCYPND
YPNSQACMWTLRAPTGYIIQITFNDFDIEEAPNCIYDSLSLDNGESQTKFCGATAKGLSFNSSA
NEMHVSFSSDFSIQKKGFNASYIRVAVSLRNQKVILPQTSDAYQVSVAKSISIPELSAFTLCFE
ATKVGHEDSDWTAFSYSNASFTQLLSFGKAKSGYFLSISDSKCLLNNALPVKEKEDIFAESFE
QLCLVWNNSLGSIGVNFKRNYETVPCDSTISKVIPGNGKLLLGSNQNEIVSLKGDIYNFRLWN
FTMNAKILSNLSCNVKGNVVDWQNDFWNIPNLALKAESNLSPEVGSYLIPLPAAELASCADLGT
LCQATVNSPSTTPPTVTTNMPVTNRIDKQRNDGIIYRISVVIQNILRHPEVKVQSKVAEWLNST
FQNWNYTVYVVNISPHLSAGEDKIKVKRSLEDEPRLVLWALLVYNATNNTNLEGKIIQQKLL
KNNESLDEGLRLHTVNVRQLGHCLAMEEPKGYYWPSIQPSEYVLPCPDKPGFSASRICFYNA
TNPLVTYWGPVDISNCLKEANEVANQILNLTADGQNLTSANITNIVEQVKRIVNKEENIDITL
GSTLMNIFSNILSSSDSDLLESSSEALKTIDELAFKIDLNSTSHVNITTRNLALSVSSLLPGTNAIS TABLE 4-continued Targets from which the Analogs are derived NFSIGLPSNNESYFQMDFESGQVDPLASVILPPNLLENLSPEDSVLRRAQFTFFNKTGLFQDV
GPQRKTLVSYVMACSIGNITIQNLKDPVQIKIKHTRTQEVHHPICAFWDLNKNKSFGGWNTS
GCVAHRDSDASETVCLCNHFTHFGVLMDLPRSASQLDARNTKVLTFISYIGCGISAIFSAATL
LTYVAFEKLRRDYPSKILMNLSTALLFLNLLFLLDGWITSFNVDGLCIAVAVLLHFFLLATFT
WMGLEAIHMYIALVKVFNTYIRRYILKFCIIGWGLPALVVSVVLASRNNNEVYGKESYGKEK
GDEFCWIQDPVIFYVTCAGYFGVMFFLNIAMFIVVMVQICGRNGKRSNRTLREEVLRNLRSV
VSLTFLLGMTWGFAFFAWGPLNIPFMYLFSIFNSLQGLFIFIFHCAMKENVQKQWRRHLCCG
RFRLADNSDWSKTATNIIKKSSDNLGKSLSSSSIGSNSTYLTSKSKSSSTTYFKRNSHTDNVSY
EHSFNKSGSLRQCFHGQVLVKTGPC
(SEQ ID NO: 1231)

>gi|74275344|ref|NP_001028252.1|trace amine-associated receptor 2 isoform 1 {Homo sapiens}
MAVSSEQHELSHFKRTQTKKEKFNCSEYGNRSCPENERSLGVRVAMYSFMAGSIFITIFGNLA
MIISISYFKQLHTPTNFLILSMAITDFLLGFTIMPYSMIRSVENCWYFGLTFCKIYYSFDLMLSIT
SIFHLCSVAIDRFYAICYPLLYSTKITIPVIKRLLLLCWSVPGAFAFGVVFSEAYADGIEGYDIL
VACSSSCPVMFNKLWGTTLFMAGFFTPGSMMVGIYGKIFAVSRKHAHAINNLRENQNNQVK
KDKKAAKTLGIVIGVFLLCWFPCFFTILLDPFLNFSTPVVLFDALTWFGYFNSTCNPLIYGFFY
PWFRRALKYILLGKIFSSCFHNTILCMQKESE
(SEQ ID NO: 1232)

>gi|84662753|ref|NP_001033794.1|G protein-coupled receptor 149 {Homo sapiens}
MSLFLSNLSTNDSSLWKENHNSTDLLNPPGTLNIYLFCLTCLMTFAALVGSIYSLISLLKMQN
RTVVSMLVASWSVDDLMSVLSVTIFMFLQWPNEVPGYFQFLCTTSALMYLCQGLSSNLKAT
LLVSYNFYTMHRGVGSQTASRRSGQVLGVVLTVWAASLLLSALPLCGWGAFVRTPWGCLV
DCSSSYVLFLSIVYALAFGLLVGLSVPLTHRLLCSEEPPRLHSNYQEISRGASIPGTPPTAGRVV
SLSPEDAPGPSLRRSGGCSPSSDTVFGPGAPAAAGAEACRRENRGTLYGTRSFTVSVAQKRFA
LILALTKVVLWLPMMMHMVVQNVVGFQSLPLETFSFLLTLLATTVTPVFVLSKRWTHLPCG
CIINCRQNAYAVASDGKKIKRKGFEFNLSFQKSYGIYKIAHEDYYDDDENSIFYHNLMNSECE
TTKDPQRDNRNIFNAIKVEISTTPSLDSSTQRGINKCTNTDITEAKQDSNNKKDAFSDKTGGDI
NYEETTFSEGPERRLSHEESQKPDLSDWEWCRSKSERTPRQRSGYALAIPLCAFQGTVSLHAP
TGKTLSLSTYEVSAEGQKITPASKKIEVYRSKSVGHEPNSEDSSSTFVDTSVKIHLEVLEICDNE
EALDTVSIISNISQSSTQVRSPSLRYSRKENRFVSCDLGETASYSLFLPTSNPDGDINISIPDTVE
AHRQNSKRQHQERDGYQEEIQLLNKAYRKREEESKGS
(SEQ ID NO: 1233)

>gi|85986587|ref|NP_001034254.1|mas-related G-protein coupled receptor member E {Homo sapiens}
MEPREAGQHVGAANGAQEDVAFNLIILSLTEGLGLGGLLGNGAVLWLLSSNVYRNPFAIYLL
DVACADLIFLGCHMVAIVPDLLQGRLDFPGFVQTSLATLRFFCYIVGLSLLAAVSVEQCLAAL
FPAWYSCRRPRHLTTCVCALTWALCLLLHLLLSGACTQFFGEPSRHLCRTLWLVAAVLLALL
CCTMCGASLMLLLRVERGPQRPPPRGFPGLILLTVLLFLFCGLPFGIYWLSRNLLWYIPHYFY
HFSFLMAAVHCAAKPVVYFCLGSAQGRRLPLRLVLQRALGDEAELGAVRETSRRGLVDIAA
(SEQ ID NO: 1234)

>gi|85986601|ref|NP_067647.2|relaxin/insulin-like family peptide receptor 1 {Homo sapiens}
MTSGSVFFYILIFGKYFSHGGGQDVKCSLGYFPCGNITKCLPQLLHCNGVDDCGNQADEDNC
GDNNGWSLQFDKYFASYYKMTSQYPFEAETPECLVGSVPVQCLCQGLELDCDETNLRAVPS
VSSNVTAMSLQWNLIRKLPPDCFKNYHDLQKLYLQNNKITSISIYAFRGLNSLTKLYLSHNRI
TFLKPGVFEDLHRLEWLIIEDNHLSRISPPTFYGLNSLILLVLMNNVLTRLPDKPLCQHMPRLH
WLDLEGNHIHNLRNLTFISCSNLTVLVMRKNKINHLNENTFAPLQKLDELDLGSNKIENLPPLI
FKDLKELSQLNLSYNPIQKIQANQFDYLVKLKSLSLEGIEISNIQQRMFRPLMNLSHIYFKKFQ
YCGYAPHVRSCKPNTDGISSLENLLASIIQRVFVWVVSAVTCFLGNIFVICMRPYIRSENKLYA
MSIISLCCADCLMGIYLFVIGGFDLKFRGEYNKHAQLWMESTHCQLVGSLAILSTEVSVLLLT
FLTLEKYICIVYPFRCVRPGKCRTITVLILIWITGFIVAFIPLSNKEFFKNYYGTNGVCFPLHSED
TESIGAQIYSVAIFLGINLAAFIIIVFSYGSMFYSVHQSAITATEIRNQVKKEMILAKRFFFIVFTD
ALCWIPIFVVKFLSLLQVEIPGTITSWVVIFILPINSALNPILYLTTTRPFKEMIHRFWYNYRQRK
SMDSKGQKTYAPSFIWVEMWPLQEMPPELMKPDLFTYPCEMSLISQSTRLNSYS
(SEQ ID NO: 1235)

>gi|88758590|ref|NP_005288.3|melanin-concentrating hormone receptor 1 {Homo sapiens}
MSVGAMKKGVGRAVGLGGGSGCQATEEDPLPNCGACAPGQGGRRWRLPQPAWVEGSSAR
LWEQATGTGWMDLEASLLPTGPNASNTSDGPDNLTSAGSPPRTGSISYINIIMPSVFGTICLLG
IIGNSTVIFAVVKKSKLHWCNNVPDIFIINLSVVDLLFLLGMPFMIHQLMGNGVWHFGETMCT
LITAMDANSQFTSTYILTAMAIDRYLATVHPISSTKFRKPSVATLVICLLWALSFSISITPVWLYA
RLIPFPGGAVGCGIRLPNPDTDLYWFTLYQFFLAFALPASQRS
AAYVRILQRMTSSVAPASQRS
IRLRTKRVTRTAIAICLVFFVCWAPYYVLQLTQLSISRPTLTFVYLYNAAISLGYANSCLNPFV
YIVLCETFRKRLVLSVKPAAQGQLRAVSNAQTADEERTESKGT
(SEQ ID NO: 1236)

>gi|89191861|ref|NP_000787.2|d(3) dopamine receptor isoform a {Homo sapiens}
MASLSQLSGHLNYTCGAENSTGASQARPHAYYALSYCALILAIVFGNGLVCMAVLKERALQ
TTTNYLVVSLAVADLLVATLVMPWVVYLEVTGGVWNFSRICCDVFVTLDVMMCTASILNL
CAISIDRYTAVVMPVHYQHGTGQSSCRRVALMITAVWVLAFAVSCPLLFGFNTTGDPTVCSI
SNPDFVIYSSVVSFYLPFGVTVLVYARIYVVLKQRRRKILTRQNSQCNSVRPGFPQQTLSPDP
AHLELKRYYSICQDTALGGPGFQERGGELKREEKTRNSLSPTIAPKLSLEVRKLSNGRLSTSL
KLGPLQPRGVPLREKKATQMVAIVLGAFIVCWLPFFLTHVLNTHCQTCHVSPELYSATTWLG
YVNSALNPVIYTTFNIEFRKAFLKILSC
(SEQ ID NO: 1237)

TABLE 4-continued

Targets from which the Analogs are derived

>gi|89257346|ref|NP_005284.2|G-protein coupled receptor 20 {Homo sapiens}
MPSVSPAGPSAGAVPNATAVTTVRTNASGLEVPLFHLFARLDEELHGTFPGLWLALMAVHG
AIFLAGLVLNGLALYVFCCRTRAKTPSVIYTINLVVTDLLVGLSLPTRFAVYYGARGCLRCAF
PHVLGYFLNMHCSILFLTCICVDRYLAIVRPEGSRRCRQPACARAVCAFVWLAAGAVTLSVL
GVTGSRPCCRVFALTVLEFLLPLLVISVFTGRIMCALSRPGLLHQGRQRRVRAMQLLLTVLIIF
LVCFTPFHARQVAVALWPDMPHHTSLVVYHVAVTLSSLNSCMDPIVYCFVTSGFQATVRGL
FGQHGEREPSSGDVVSMHRSSKGSGRHHILSAGPHALTQALANGPEA
(SEQ ID NO: 1238)

>gi|89353783|ref|NP_003941.2|proteinase-activated receptor 4 precursor {Homo sapiens}
MWGRLLLWPLVLGFSLSGGTQTPSVYDESGSTGGGDDSTPSILPAPRGYPGQVCANDSDTLE
LPDSSRALLLGWVPTRLVPALYGLVLVVGLPANGLALWVLATQAPRLPSTMLLMNLAAADL
LLALALPPRIAYHLRGQRWPFGEAACRLATAALYGHMYGSVLLLAAVSLDRYLALVHPLRA
RALRGRRLALGLCMAAWLMAAALALPLTLQRQTFRLARSDRVLCHDALPLDAQASHWQPA
FTCLALLGCFLPLLAMLLCYGATLHTLAASGRRYGHALRLTAVVLASAVAFFVPSNLLLLLH
YSDPSPSAWGNLYGAYVPSLALSTLNSCVDPFIYYYVSAEFRDKVRAGLFQRSPGDTVASKA
SAEGGSRGMGTHSSLLQ
(SEQ ID NO: 1239)

>gi|91106202|ref|NP_005286.2|probable G-protein coupled receptor 22 {Homo sapiens}
MCFSPILEINMQSESNITVRDDIDDINTNMYQPLSYPLSFQVSLTGFLMLEIVLGLGSNLTVLV
LYCMKSNLINSVSNIITMNLHVLDVIICVGCIPLTIVILLLSLESNTALICCFHEACVSFASVSTAI
NVFAITLDRYDISVKPANRILTMGRAVMLMISIWIFSFFSFLIPFIEVNFFSLQSGNTWENKTLL
CVSTNEYYTELGMYYHLLVQIPIFFFTVVVMLITYTKILQALNIRIGTRFSTGQKKARKKKTI
SLTTQHEATDMSQSSGGRNVVFGVRTSVSVIIALRRAVKRHERRERQKRVFRMSLLIISTFL
LCWTPISVLNTTILCLGPSDLLVKLRLCFLVMAYGTTIFHPLLYAFTRQKFQKVLKSKMKKRV
VSIVEADPLPNNAVIHNSWIDPKRNKKITFEDSEIREKCLVPQVVTD
(SEQ ID NO: 1240)

>gi|93204867|ref|NP_065803.2|probable G-protein coupled receptor 158 precursor {Homo sapiens}
MGAMAVPLLLCLLLAQLGLGAVGASRDPQGRPDSPRERTPKGKPHAQQPGRASASDSSAPW
SRSTDGTILAQKLAEEVPMDVASYLYTGDSHQLKRANCSGRYELAGLPGKWPALASAHPSL
HRALDTLTHATNFNLNVMLQSNKSREQNLQDDLDWYQALVWSLLEGEPSISRAAITFSTDSLS
APAPQVFLQATREESRILLQDLSSSAPHLANATLETEWFHGLRRKWRPHLHRRGPNQGPRGL
GHSWRRKDGLGGDKSHFKWSPPYLECENGSYKPGWLVTLSSAIYGLQPNLVPEFRGVMKV
DINLQKVDIDQCSSDGWFSGTHKCHLNNSECMPIKGLGFVLGAYECICKAGFYHPGVLPVNN
FRRRGPDQHISGSTKDVSEEAYVCLPCREGCPFCADDSPCFVQEDKYLRLAIISFQALCMLLD
FVSMLVVYHFRKAKSIRASGLILLETILFGSLLLYFPVVILYFEPSTFRCILLRWARLLGFATVY
GTVTLKLHRVLKVFLSRTAQRIPYMTGGRVMRMLAVILLVVPWFLIGWTSSVCQNLEKQISL
IGQGKTSDHLIFNMCLIDRWDYMTAVAEFLFLLWGVYLCYAVRTVPSAFHEPRYMAVAVH
NELIISAIFHTIRFVLASRLQSDWMLMLYFAHTHLTVTVTIGLLLIPKFSHSSNNPRDDIATEAY
EDELDMGRSGSYLNSSINSAWSEHSLDPEDIRDELKKLYAQLEIYKRKKMITNNPHLQKKRC
SKKGLGRSIMRRITEIPETVSRQCSKEDKEGADHGTAKGTALIRKNPPESSGNTGKSKEETLK
NRVFSLKKSHSTYDHVRDQTEESSSLPTESQEEETTENSTLESLSGKKLTQKLKEDSEAESTES
VPLVCKSASAHNLSSEKKTGHPRTSMLQKSLSVIASAKEKTLGLAGKTQTAGVEERTKSQKP
LPKDKETNRNHSNSDNTETKDPAPQNSNPAEEPRKPQKSGIMKQQRVNPTTANSDLNPGTTQ
MKDNFDIGEVCPWEVYDLTPGPVPSESKVQKHVSIVASEMEKNPTFSLKEKSHHKPKAAEVC
QQSNQKRIDKAEVCLWESQGQSILEDEKLLISKTPVLPERAKEENGGQPRAANVCAGQSEEL
PPKAVASKTENENLNQIGHQEKKTSSSEENVRGSYNSSNNFQQPLTSRAEVCPWEFETPAQPN
AGRSVALPASSALSANKIAGPRKEEIWDSFKV
(SEQ ID NO: 1241)

>gi|93204873|ref|NP_079256.4|probable G-protein coupled receptor 157 {Homo sapiens}
MQPSPPPTELVPSERAVVLLSCALSALGSGLLVATHALWPDLRSRARRLLLFLSLADLLSAAS
YFYGVLQNFAGPSWDCVLQGALSTFANTSSFFWTVAIALYLYLSIVRAARGPRTDRLLWAFH
VVSWGVPLVITVAAVALKKIGYDASDVSVGWCWIDLEAKDHVLWMLLTGKLWEMLAYVL
LPLLYLLVRKHINRAHTALSEYRPILSQEHRLLRHSSMADKKLVLIPLIFIGLRVWSTVRFVLT
LCGSPAVQTPVLVVLHGIGNTFQGGANCIMFVLCTRAVRTRLFSLCCCCCSSQPPTKSPAGTP
KAPAPSKPGESQESQGTPGELPST
(SEQ ID NO: 1242)

>gi|93277083|ref|NP_001035269.1|melanin-concentrating hormone receptor 2 {Homo sapiens}
MNPFHASCWNTSAELLNKSWNKEFAYQTASVVDTVILPSMIGIICSTGLVGNILIVFTIIRSRK
KTVPDIYICNLAVADLVHIVGMPFLIHQWARGGEWVFGGPLCTIITSLDTCNQFACSAIMTVM
SVDRYFALVQPFRLTRWRTRYKTIRINLGLWAASFILALPVWVYSKVIKFKDGVESCAFDLTS
PDDVLWYTLYLTITTFFFPLPLILVCYILILCYTWEMYQQNKDARCCNPSVPKQRVMKLTKM
VLVLVVVFILSAAPYHVIQLVNLQMEQPTLAFYVGYYLSICLSYASSSINPFLYILLSGNFQKR
LPQIQRRATEKEINNMGNTLKSHF
(SEQ ID NO: 1243)

>gi|93352554|ref|NP_001004334.2|probable G-protein coupled receptor 179 precursor {Homo sapiens}
MGTRGAVMPPPMWGLLGCCFVCAWALGGPRPIRSLPPLSSQVKPGSVPMQVPLEGAEAALA
YLYSGDAQQLSQVNCSERYEARGAGAMPGLPPSLQGAAGTLAQAANFLNMLLQANDIRESS
VEEDVEWYQALVRSVAEGDPRVYRALLTFNPPPGASHLQLALQATRTGEETILQDLSGNWV
QEENPPGDLDTPALKKRVLTNDLGSLGSPKWPQADGYVGDTQQVRLSPPFLECQEGRLRPG
WLITLSATFYGLKPDLSPEVRGQVQMDVDLQSVDINQCASGPGWYSNTHLCDLNSTQCVPL TABLE 4-continued Targets from which the Analogs are derived ESQGFVLGRYLCRCRPGFYGASPSGGLEESDFQTTGQFGFPEGRSGRLLQCLPCPEGCTSCMD
ATPCLVEEAAVLRAAVLACQACCMLAIFLSMLVSYRCRRNKRIWASGVVLLETVLFGFLLLY
FPVFILYFKPSVFRCIALRWVRLLGFAIVYGTIILKLYRVLQLFLSRTAQRSALLSSGRLLRRLG
LLLLPVLGFLAVWTVGALERGIQHAPLVIRGHTPSGRHFYLCHHDRWDYIMVVAELLLLCW
GSFLCYATRAVLSAPHEPRYMGIALHNELLLSAAFHTARFVLVPSLHPDWTLLLFFFHTHSTV
TTTLALIFIPKFWKLGAPPREEMVDEVCEDELDLQHSGSYLGSSIASAWSEHSLDPGDIRDELK
KLYAQLEVHKTKEMAANNPHLPKKRGSSCQGLGRSFMRYLAEFPEALARQHSRDSGSPGHG
SLPGSSRRRLLSSSLQEPEGTPALHKSRSTYDQRREQDPPLLDSLLRRKLAKKASRTESRESVE
GPPALGFRSASAHNLTVGERLPRARPASLQKSLSVASSREKALLMASQAYLEETYRQAKERE
ERKKAKAAMASLVRRPSARRLERPRGAPLSAPPSPAKSSSVDSSHTSGRLHEEARRRLPHPPI
RHQVSTPILALSGGLGEPRMLSPTSTLAPALLPALAPTPAPALAPVPVSPQSPNLLTYICPWEN
AELPAKQENVPQEGPSGPERGHHSPAPARARLWRALSVAVEKSRAGENEMDAEDAHHQRE
ANDVDEDRPKIFPKSHSLKAPVQQGSMRSLGLAIKALTRSRSTYREKESVEESPEGQNSGTAG
ESMGAPSRSPRLGRPKAVSKQAALIPSDDKESLQNQQNAHTSRMLQVCQREGSREQEDRGR
RMTQGLGERKAERAGKTGLAMLRQVSRDKNIKQSKETPVGWQELPKAGLQSLGSADHRVA
EVCPWEVTESETRQPDSGNKAEICPWETSEGAPESRALRQDPGDSQKKRGEARGKSEPIDVV
PMMRKKPERLVREQEAVCPWESADRGGLSPGSAPQDPGRIRDKSEAGDSVEARKVEKPGWE
AAGPEAHTPDITKAEPCPWEASEGGEDGKPAQEAVKDLPQEKQKTRKATFWKEQKPGGDLE
SLCPWESTDFRGPSAVSIQAPGSSECSGSLGSGIAEVCLWEAGDAPAIQKAEICPWELDDNVM
GQEMLSLGTGRESLQEKEKASRKGSFGEMGEQTVKAVQKLSQQQESVCPRESTVPGHSSPCL
DNSSSKAGSQFLCNGGSRATQVCPQEDLRPEAQEATPAKTEICPWEVNERTREEWTSAQVPR
GGESQKDKEKMPGKSEIEDVTAWEKPEGQIQKQEAVGPWESVDPGSFSPQPRPQDTERPQTL
LQMSGSVGSKAADICPLDVEENLTAGKAEICPWEVGAGAGEERALGAEAIRKSPNDTGKVS
ADLGPRERAVTAPEKPQKPTPEWEVACPWGSVGPGACSQHPGTLDADGPKAGFQELDHMG
CRPGEVCPWEAQEAATSEKAKICPWEVSEGTTGKGLDQKAGSESAEQREKALEKGRLTSLG
EDVSKGMAKLCQQQETICIWENKDLRESPAQAPKISDLPSSMSSEVAEGHSLEATEKGDLRQ
DPKTGSFPEHITQEKAPAADTEEFTTEDGEKTSHELQSVCPWETTAPADSVSHLDRQRPDQPK
ASSQRLVSTGGRAADVCPWDVPDAGVYKSDSSAKAETCPWEVTERIPVKGVSRQDGKGDS
QEEKGRAPEKSEPKGVPVQKKPEMADFRQQEAVCPWESQDGKGLSPQPAPDASDRSRGSSE
AAGSVETRVAEVCLWEVVEAPSAKKAEICPWEAGGGAAEEGEQERESQGQGEMFLQKAGP
GGTEEHFSKAAAKPREQEAVCPGEGTGSGGLLPQSGALDPELKVSPKEAGSMGSRMAELCQ
WEITDPEGNKIKGTMADICPGEETGVPSEESGLLALTATRREFFPTAPEKPLCLLVHGPLDHFF
PESKIPCPKVSRPASTFTLEGVRELQGPSGLEPRTSLAPEPSLQEAESQSSSLTEDSGQVAFEAQ
YEEFTPPTVYPWDWE
(SEQ ID NO: 1244)

>gi|106067657|ref|NP_000224.2|luteinizing hormone/choriogonadotropin receptor precursor {Homo sapiens}
MKQRFSALQLLKLLLLLQPPLPRALREALCPEPCNCVPDGALRCPGPTAGLTRLSLAYLPVKV
IPSQAFRGLNEVIKIEISQIDSLERIEANAFDNLLNLSEILIQNTKNLRYIEPGAFINLPRLKYLSIC
NTGIRKFPDVTKVFSSESNFILEICDNLHITTIPGNAFQGMNNESVTLKLYGNGFEEVQSHAFN
GTTLTSLELKENVHLEKMHNGAFRGATGPKTLDISSTKLQALPSYGLESIQRLIATSSYSLKKL
PSRETFVNLLEATLTYPSHCCAFRNLPTKEQNFSHSISENFSKQCESTVRKVNNKTLYSSMLA
ESELSGWDYEYGFCLPKTPRCAPEPDAFNPCEDIMGYDFLRVLIWLINILAIMGNMTVLFVLL
TSRYKLTVPRFLMCNLSFADFCMGLYLLLIASVDSQTKGQYYNHAIDWQTGSGCSTAGFFTV
FASELSVYTLTVITLERWHTITYAIHLDQKLRLRHAILIMLGGWLFSSLIAMLPLVGVSNYMK
VSICFPMDVETTLSQVYILTILILNVVAFFIICACYIKIYFAVRNPELMATNKDTKIAKKMAILIF
TDFTCMAPISFFAISAAFKVPLITVTNSKVLLVLFYPINSCANPFLYAIFTKTFQRDFFLLLSKFG
CCKRRAELYRRKDFSAYTSNCKNGFTGSNKPSQSTLKLSTLHCQGTALLDKTRYTEC
(SEQ ID NO: 1245)

>gi|110611176|ref|NP_000834.2|metabotropic glutamate receptor 6 precursor {Homo sapiens}
MARPRRAREPLLVALLPLAWLAQAGLARAAGSVRLAGGLTLGGLFPVHARGAAGRACGQL
KKEQGVHRLEAMLYALDRVNADPELLPGVRLGARLLDTCSRDTYALEQALSFVQALIRGRG
DGDEVGVRCPGGVPPLRPAPPERVVAVVGASASSVSIMVANVLRLFAIPQISYASTAPELSDS
TRYDFFSRVVPPDSYQAQAMVDIVRALGWNYVSTLASEGNYGESGVEAFVQISREAGGVCI
AQSIKIPREPKPGEFSKVIRRLMETPNARGIIIFANEDDIRRVLEAARQANLTGHFLWVGSDSW
GAKTSPILSLEDVAVGAITILPKRASIDGFDQYFMTRSLENNRRNIWFAEFWEENFNCKLTSSG
TQSDDSTRKCTGEERIGRDSTYEQEGKVQFVIDAVYAIAHALSMHQALCPGHTGLCPAMEP
TDGRMLLQYIRAVRFNGSAGTPVMFNENGDAPGRYDIFQYQATNGSASSGGYQAVGQWAE
TLRLDVEALQWSGDPHEVPSSLCSLPCGPGERKKMVKGVPCCWHCEACDGYRFQVDEFTCE
ACPGDMRPTPNHTGCRPTPVVRLSWSSPWAAPPLLLAVLGIVATTTVVATFVRYNNTPIVRA
SGRELSYVLLTGIFLIYAITFLMVAEPGAAVCAARRLFLGLGTTLSYSALLTKTNRIYRIFEQG
KRSVTPPPFISPTSQLVITFSLTSLQVVGMIAWLGARPPHSVIDYEEQRTVDPEQARGVLKCD
MSDLSLIGCLGYSLLLMVTCTVYAIKARGVPETFNEAKPIGFTMYTTCIIWLAFVPIFFGTAQS
AEKIYIQTTTLTVSLSLSASVSLGMLYVPKTYVILFHPEQNVQKRKRSLKATSTVAAPPKGED
AEAHK
(SEQ ID NO: 1246)

>gi|110611243|ref|NP_002522.2|neurotensin receptor type 1 {Homo sapiens}
MRLNSSAPGTPGTPAADPFQRAQAGLEEALLAPGFGNASGNASERVLAAPSSELDVNTDIYS
KVLVTAVYLALFVVGTVGNTVAFTLARKKSLQSLQSTVHYHLGSLALSDLLTLLLAMPVE
LYNFIWVHHPWAFGDAGCRGYYFLRDACTYATALNVASLSVERYLAICHPFKAKTLMSRSR
TKKFISAIWLASALLAVPMLFTMGEQNRSADGQHAGGLVCTPTIHTATVKVVIQVNTFMSFIF
PMVVISVLNTIIANKLTVMRQAAEQGQVCTVGGEHSTFSMAIEPGRVQALRHGVRVLRAV
VIAFVVCWLPYHVRRLMFCYISDEQWTPFLYDFYHYFYMVTNALFYVSSTINPILYNLVSAN
FRHIFLATLACLCPVWRRRRKRPAFSRKADSVSSNHTLSSNATRETLY
(SEQ ID NO: 1247)

TABLE 4-continued

Targets from which the Analogs are derived

>gi|110618256|ref|NP_778227.3|trace amine-associated receptor 9 {Homo sapiens}
MVNNFSQAEAVELCYKNVNESCIKTPYSPGPRSILYAVLGFGAVLAAFGNLLVMIAILHFKQL
HTPTNFLIASLACADFLVGVTVMPFSTVRSVESCWYFGDSYCKFHTCFDTSFCFASLFHLCCIS
VDRYIAVTDPLTYPTKFTVSVSGICIVLSWFFSVTYSFSIFYTGANEEGIEELVVALTCVGGCQ
APLNQNWVLLCFLLFFIPNVAMVFIYSKIFLVAKHQARKIESTASQAQSSSESYKERVAKRER
KAAKTLGIAMAAFLVSWLPYLVDAVIDAYMNFITPPYVYEILVWCVYYNSAMNPLIYAFFY
QWFGKAIKLIVSGKVLRTDSSTTNLFSEEVETD
(SEQ ID NO: 1248)

>gi|111118992|ref|NP_000671.2|alpha-1A adrenergic receptor isoform 1 {Homo sapiens}
MVFLSGNASDSSNCTQPPAPVNISKAILLGVILGGLILFGVLGNILVILSVACHRHLHSVTHYYI
VNLAVADLLLTSTVLPFSAIFEVLGYWAFGRVFCNIWAAVDVLCCTASIMGLCIISIDRYIGVS
YPLRYPTIVTQRRGLMALLCVWALSLVISIGPLFGWRQPAPEDETICQINEEPGYVLFSALGSF
YLPLAIILVMYCRVYVVAKRESRGLKSGLKTDKSDSEQVTLRIHRKNAPAGGSGMASAKTKT
HFSVRLLKFSREKKAAKTLGIVVGCFVLCWLPFFLVMPIGSFFPDFKPSETVFKIVFWLGYLNS
CINPIIYPCSSQEFKKAFQNVLRIQCLCRKQSSKHALGYTLHPPSQAVEGQHKDMVRIPVGSRE
TFYRISKTDGVCEWKFFSSMPRGSARITVSKDQSSCTTARVRSKSFLQVCCCVGPSTPSLDKN
HQVPTIKVHTISLSENGEEV
(SEQ ID NO: 1249)

>gi|111118994|ref|NP_001693.2|brain-specific angiogenesis inhibitor 1 precursor {Homo sapiens}
MRGQAAAPGPVWILAPLLLLLLLLGRRARAAAGADAGPGPEPCATLVQGKFFGYFSAAAVF
PANASRCSWTLRNPDPRRYTLYMKVAKAPVPCSGPGRVRTYQFDSFLESRTRTYLGVESFDEV
LRLCDPSAPLAFLQASKQFLQMRRQQPPQHDGLRPRAGPPGPTDDFSVEYLVVGNRNPSRAA
CQMLCRWLDACLAGSRSSHPCGIMQTPCACLGGEAGGPAAGPLAPRGDVCLRDAVAGGPE
NCLTSLTQDRGGHGATGGWKLWSLWGECTRDCGGGLQTRTRTCLPAPGVEGGGCEGVLEE
GRQCNREACGPAGRTSSRSQSLRSTDARRREELGDELQQFGFPAPQTGDPAAEEWSPWSVCS
STCGEGWQTRTRFCVSSSYSTQCSGPLREQRLCNNSAVCPVHGAWDEWSPWSLCSSTCGRG
FRDRTRTCRPPQFGGNPCEGPEKQTKFCNIALCPGRAVDGNWNEWSSWSACSASCSQGRQQ
RTRECNGPSYGGAECQGHWVETRDCFLQQCPVDGKWQAWASWGSCSVTCGAGSQRRERV
CSGPFFGGAACQGPQDEYRQCGTQRCPEPHEICDEDNFGAVIWKETPAGEVAAVRCPRNAT
GLILRRCELDEEGIAYWEPPTYIRCVSIDYRNIQMMTREHLAKAQRGLPGEGVSEVIQTLVEIS
QDGTSYSGDLLSTIDVLRNMTEIFRRAYYSPTPGDVQNFVQILSNLLAEENRDKWEEAQLAG
PNAKELFRLVEDFVDVIGFRMKDLRDAYQVTDNLVLSIHKLPASGATDISFPMKGWRATGD
WAKVPEDRVTVSKSVFSTGLTEADEASVFVVGTVLYRNLGSFLALQRNTTVLNSKVISVTVK
PPPRSLRTPLEIEFAHMYNGTTNQTCILWDETDVPSSSAPPQLGPWSWRGCRTVPLDALRTRC
LCDRLSTFAILAQLSADANMEKATLPSVTLIVGCGVSSLTLLMLVIIYVSVWRYIRSERSVILIN
FCLSIISSNALILIGQTQTRNKVVCTLVAAFLHFFFLSSFCWVLTEAWQSYMAVTGHLRNRLIR
KRFLCLGWGLPALVVAISVGFTKAKGYSTMNYCWLSLEGGLLYAFVGPAAAVVLVNMVIGI
LVFNKLVSKDGITDKKLKERAGASLWSSCVVLPLLALTWMSAVLAVTDRRSALFQILFAVFD
SLEGFVIVMVHCILRREVQDAVKCRVVDRQEEGNGDSGGSFQNGHAQLMTDFEKDVDLAC
RSVLNKDIAACRTATITGTLKRPSLPEEEKLKLAHAKGPPTNFNSLPANVSKLHLHGSPRYPG
GPLPDFPNHSLTLKRDKAPKSSFVGDGDIFKKLDSELSRAQEKALDTSYVILPTATATLRPKPK
EEPKYSIHIDQMPQTRLIHLSTAPEASLPARSPPSRQPPSGGPPEAPPAQPPPPPPPPPPPQQPLP
PPPNLEPAPPSLGDPGEPAAHPGPSTGPSTKNENVATLSVSSLERRKSRYAELDFEKIMHTRKR
HQDMFQDLNRKLQHAAEKDKEVLGPDSKPEKQQTPNKRPWESLRKAHGTPTWVKKELEPL
QPSPLELRSVEWERSGATIPLVGQDIIDLQTEV
(SEQ ID NO: 1250)

>gi|112807234|ref|NP_683766.2|G-protein coupled receptor family C group 6 member A precursor
{Homo sapiens}
MAFLIILITCFVIILATSQPCQTPDDFVAATSPGHIIIGGLFAIHEKMLSSEDSPRRPQIQECVGFEI
SVFLQTLAMIHSIEMINNSTLLPGVKLGYEIYDTCTEVTVAMAATLRFLSKFNCSRETVEFKC
DYSSYMPRVKAVIGSGYSEITMAVSRMLNLQLMPQVGYESTAEILSDKIRFPSFLRTVPSDFH
QIKAMAHLIQKSGWNWIGIITTDDDYGRLALNTFIIQAEANNVCIAFKEVLPAFLSDNTIEVRI
NRTLKKIILEAQVNVIVVFLRQFHVFDLFNKAIEMNINKMWIASDNWSTATKITTIPNVKKIG
KVVGFAFRRGNISSFHSFLQNLHLLPSDSHKLLHEYAMHLSACAYVKDTDLSQCIFNHSQRTL
AYKANKAIERNFVMRNDFLWDYAEPGLIHSIQLAVFALGYAIRDLCQARDCQNPNAFQPWE
LLGVLKNVTFTDGWNSFHFDAHGDLNTGYDVVLWKEINGHMTVTKMAEYDLQNDVFIIPD
QETKNEFRNLKQIQSKCSKECSPGQMKKTTRSQHICCYECQNCPENHYTNQTDMPHCLLCN
NKTHWAPVRSTMCFEKEVEYLNWNDSLAILLLILSLLGIIFVLVVGIIFTRNLNTPVVKSSGGL
RVCYVILLCHFLNFASTSFFIGEPQDFTCKTRQTMFGVSFTLCISCILTKSLKILLAFSFDPKLQK
FLKCLYRPILIIFTCTGIQVVICTLWLIFAAPTVEVNVSLPRVIILECEEGSILAFGTMLGYIAILA
FICFIFAFKGKYENYNEAKFITFGMLIYFIAWITFIPIYATTFGKYVPAVEIIVILISNYGILYCTFI
PKCYVIICKQEINTKSAFLKMIYSYSSHSVSSIALSPASLDSMSGNVTMTNPSSSGKSATWQKS
KDLQAQAFAHICRENATSVSKTLPRKRMSSI
(SEQ ID NO: 1251)

>gi|113722120|ref|NP_115495.3|G-protein coupled receptor 98 precursor {Homo sapiens}
MSVFLGPGMPSASLLVNLLSALLILFVFGETEIRFTGQTEFVVNETSTTVIRLIIERIGEPANVTA
IVSLYGEDAGDFFDTYAAAFIPAGETNRTVYIAVCDDDLPEPDETFIFHLTLQKPSANVKLGW
PRTVTVTILSNDNAFGIISFNMLPSIAVSEPKGRNESMPLTLIREKGTYGMVMVTFEVEGGPNP
PDEDLSPVKGNITFPPGRATVIYNLTVLDDEVPENDEIFLIQLKSVEGGAEINTSRNSIEIIIKKN
DSPVRFLQSIYLVPEEDHILIIPVVRGKDNNGNLIGSDEYEVSISYAVTTGNSTAHAQQNLDFID
LQPNTTVVFPPFIHESHLKFQIVDDTIPEIAESFHIMLLKDTLQGDAVLISPSVVQVTIKPNDKP
YGVLSFNSVLFERTVIIDEDRISRYEEITVVRNGGTHGNVSANWVLTRNSTDPSPVTADIRPSS
GVLHFAQGQMLATIPLTVVDDDLPEEAEAYLLQILPHTIRGGAEVSEPAELLFYIQDSDDVYG TABLE 4-continued Targets from which the Analogs are derived

```
LITFFPMENQKIESSPGERYLSLSFTRLGGTKGDVRLLYSVLYIPAGAVDPLQAKEGILNISRRN
DLIFPEQKTQVTTKLPIRNDAFLQNGAHFLVQLETVELLNIIIPLIPPISPRFGEICNISLLVTPAIA
NGEIGFLSNLPIILHEPEDFAAEVVYIPLHRDGTDGQATVYWSLKPSGFNSKAVTPDDIGPFNG
SVLFLSGQSDTTINITIKGDDIPEMNETVTLSLDRVNVENQVLKSGYTSRDLIILENDDPGGVF
EFSPASRGPYVIKEGESVELHIIRSRGSLVKQFLHYRVEPRDSNEFYGNTGVLEFKPGEREIVIT
LLARLDGIPELDEHYWVVLSSHGERESKLGSATIVNITILKNDDPHGIIEFVSDGLIVMINESKG
DAIYSAVYDVVRNRGNFGDVSVSWVVSPDFTQDVFPVQGTVVFGDQEFSKNITIYSLPDEIPE
EMEEFTVILLNGTGGAKVGNRTTATLRIRRNDDPIYFAEPRVVRVQEGETANFTVLRNGSVD
VTCMVQYATKDGKATARERDFIPVEKGETLIFEVGSRQQSISIFVNEDGIPETDEPFYIILLNST
GDTVVYQYGVATVIIEANDDPNGIFSLEPIDKAVEEGKTNAFWILRHRGYFGSVSVSWQLFQ
NDSALQPGQEFYETSGTVNFMDGEEAKPIILHAFPDKIPEFNEFYFLKLVNISGGSPGPGGQLA
ETNLQVTVMVPFNDDPFGVFILDPECLEREVAEDVLSEDDMSYITNFTILRQQGVFGDVQLG
WEILSSEFPAGLPPMIDFLLVGIFPTTVHLQQHMRRHHSGTDALYFTGLEGAFGTVNPKYHPS
RNNTIANFTFSAWVMPNANTNGFIIAKDDGNGSIYYGVKIQTNESHVTLSLHYKTLGSNATYI
AKTTVMKYLEESVWLHLLIILEDGIIEFYLDGNAMPRGIKSLKGEAITDGPGILRIGAGINGND
RFTGLMQDVRSYERKLTLEEIYELHAMPAKSDLHPISGYLEFRQGETNKSFIISARDDNDEEG
EELFILKLVSVYGGARISEENTTARLTIQKSDNANGLFGFTGACIPEIAEEGSTISCVVERTRGA
LDYVHVFYTISQIETDGINYLVDDFANASGTITFLPWQRSEVLNIYVLDDDIPELNEYFRVTLV
SAIPGDGKLGSTPTSGASIDPEKETTDITIKASDHPYGLLQPTGLPPQPKDAMTLPASSVPHIT
VEEEDGEIRLLVIRAQGLLGRVTAEFRTVSLTAFSPEDYQNVAGTLEFQPGERYKYIFINITDN
SIPELEKSFKVELLNLEGGVAELFRVDGSGSGDGDMEFFLPTIHKRASLGVASQILVTIAASDH
AHGVFEFSPESLFVSGTEPEDGYSTVTLNVIRHHGTLSPVTLHWNIDSDPDGLAFTSGNITFE
IGQTSANITVEILPDEDPELDKAFSVSVLSVSSGSLGAHINATLTVLASDDPYGIFIFSEKNRPV
KVEEATQNITLSIIRLKGLMGKVLVSYATLDDMEKPPYFFPNLARATQGRDYIPASGFALFGA
NQSEATIAISILDDDEPERSESVFIELLNSTLVAKVQSRSIPNSPRLGPKVETIAQLIIIANDDAFG
TLQLSAPIVRVAENHVGPIINVTRTGGAFADVSVKFKAVPITAIAGEDYSIASSDVVLLEGETS
KAVPIYVINDIYPELEESFLVQLMNETTGGARLGALTEAVIIIEASDDPYGLFGFQITKLIVEEPE
FNSVKVNLPIIRNSGTLGNVTVQWVATINGQLATGDLRVVSGNVTFAPGETIQTLLLEVLAD
DVPEIEEVIQVQLTDASGGGTIGLDRIANIIIPANDDPYGTVAFAQMVYRVQEPLERSSCANIT
VRRSGGHFGRLLLFYSTSDIDVVALAMEEGQDLLSYYESPIQGVPDDLWRTWMNVSAVGEP
LYTCATLCLKEQACSAFSFFSASEGPQCFWMTSWISPAVNNSDFWTYRKNMTRVASLFSGQ
AVAGSDYEPVTRQWAIMQEGDEFANLTVSILPDDFPEMDESFLISLLEVHLMNISASLKNQPT
IGQPNISTVVIALNGDAFGVFVIYNISPNTSEDGLFVEVQEQPQTLVELMIHRTGGSLGQVAVE
WRVVGGTATEGLDFIGAGEILTFAEGETKKTVILTILDDSEPEDDESIIVSLVYTEGGSRILPSS
DTVRVNILANDNVAGIVSFQTASRSVIGHEGEILQFHVIRTPGRGNVTVNWKIIGQNLELNFA
NFSGQLFFPEGSLNTTLFVHLLDDNIPEEKEVYQVILYDVRTQGVPPAGIALLDAQGYAAVLT
VEASDEPHGVLNFALSSRFVLLQEANITIQLFINREFGSLGAINVTYTTVPGMLSLKNQTVGNL
AEPEVDFVPIIGFLILEEGETAAAINITILEDDVPELEEYFLVNLTYVGLTMAASTSFPPRLDSEG
LTAQVIIDANDGARGVIEWQQSRFEVNETHGSLTLVAQRSREPLGHVSLFVYAQNLEAQVGL
DYIFTPMILHFADGERYKNVNIMILDDDIPEGDEKFQLILTNPSPGLELGKNTIALIIVLANDDG
PGVLSFNNSEHFFLREPTALYVQESVAVLYIVREPAQGLFGTVTVQFIVTEVNSSNESKDLTPS
KGYIVLEEGVRFKALQISAILDTEPEMDEYFVCTLFNPTGGARLGVHVQTLITVLQNQAPLGL
FSISAVENRATSIDIEEANRTVYLNVSRTNGIDLAVSVQWETVSETAFGMRGMDVVFSVFQSF
LDESASGWCFFTLENLIYGIMLRKSSVTVYRWQGIFIPVEDLNIENPKTCEAFNIGFSPYFVITH
EERNEEKPSLNSVFTFTSGFKLFLVQTIIILESSQVRYFTSDSQDYLIIASQRDDSELTQVFRWN
GGSFVLHQKLPVRGVLTVALFNKGGSVFLAISQANARLNSLLFRWSGSGFINFQEVPVSGTTE
VEALSSANDIYLIFAENVFLGDQNSIDIFIWEMGQSSFRYFQSVDFAAVNRIHSFTPASGIAHIL
LIGQDMSALYCWNSERNQFSFVLEVPSAYDVASVTVKSLNSSKNLIALVGAHSHIYELAYISS
HSDFIPSSGELIFEPGEREATIAVNILDDTVPEKEESFKVQLKNPKGGAEIGINDSVTITILSNDD
AYGIVAFAQNSLYKQVEEMEQDSLVTLNVERLKGTYGRITIAWEADGSISDIFPTSGVILFTEG
QVLSTITLTILADNIPELSEVVIVTLTRITTEGVEDSYKGATIDQDRSKSVITTLPNDSPFGLVG
WRAASVFIRVAEPKENTTTLQLQIARDKGLLGDIAIHLRAQPNFLLHVDNQATENEDYVLQE
TIIIMKENIKEAHAEVSILPDDLPELEEGFIVTITEVNLVNSDFSTGQPSVRRPGMEIAEIMIEEN
DDPRGIFMFHVTRGAGEVITAYEVPPPLNVLQVPVVRLAGSFGAVNVYWKASPDSAGLEDF
KPSHGILEFADKQVTAMIEITIIDDAEFELTETFNISLISVAGGGRLGDDVVVTVVIPQNDSPFG
VFGFEEKTVMIDESLSSDDPDSYVTLTVVRSPGGKGTVRLEWTIDEKAKHNLSPLNGTLHFD
ETESQKTIVLHTLQDTVLEEDRRFTIQLISIDEVEISPVKGSASIIIRGDKRASGEVGIAPSSRHILI
GEPSAKYNGTAIISLVRGPGILGEVTVFWRIFPPSVGEFAETSGKLTMRDEQSAVIVVIQALND
DIPEEKSFYEFQLTAVSEGGVLSESSSTANITVVASDSPYGRFAFSHEQLRVSEAQRVNITIRSS
GDFGHVRLWYKTMSGTAEAGLDFVPAAGELLFEAGEMRKSLHVEILDDDYPEGPEEFSLTIT
KVELQGRGYDFTIQENGLQIDQPPEIGNISIVRIIIMKNDNAEGIIEFDPKYTAFEVEEDVGLIMI
PVVRLHGTYGYVTADFISQSSSASPGGVDYILHGSTVTFQHGQNLSFINISIIDDNESEFEEPIEI
LLTGATGGAVLGRHLVSRIIIAKSDSPFGVIRFLNQSKISIANPNSTMILSLVLERTGGLLGEIQV
NWETVGPNSQEALLPQNRDIADPVSGLFYFGEGEGGVRTIILTIYPHEEIEVEETFIIKLHLVKG
EAKLDSRAKDVTLTIQEFGDPNGVVQFAPETLSKKTYSEAPLALEGPLLITFFVRRVKGTFGEIM
VYWELSSEFDITEDFLSTSGFFTIADGESEASFDVHLLPDEVPEIEEDYVIQLVSVEGGAELDLE
KSITWFSVYANDDPHGVFALYSDRQSILIGQNLIRSIQINITRLAGTFGDVAVGLRISSDHKEQP
IVTENAERQLVVKDGATYKVDVVPIKNQVFLSLGSNFTLQLVTVMLVGGRFYGMPTILQEA
KSAVLPVSEKAANSQVGFESTAFQLMNITAGTSHVMISRRGTYGALSVAWTTGYAPGLEIPE
FIVVGNMTPTLGSLSFSHGEQRKGVFLWTFPSPGWPEAFVLHLSGVQSSAPGGAQLRSGFIVA
EIEPMGVFQFSTSSRNIIVSEDTQMIRLHVQRLFGFHSDLIKVSYQTTAGSAKPLEDFEPVQNG
ELFFQKFQTEVDFEITIINDQLSEIEEFFYINLTSVEIRGLQKFDVNWSPRLNLDFSVAVITILDN
DDLAGMDISFPETTVAVAVDTTLIPVETESTTYLSTSKTTTILQPTNVVAIVTEATGVSAIPEKL
VTLHGTPAVSEKPDVATVTANVSIHGTFSLGPSIVYIEEEMKNGTFNTAEVLIRRTGGFTGNV
SITVKTFGERCAQMEPNALPFRGIYGISNLTWAVEEEDFEEQTLTLIFLDGERERKVSVQILDD
DEPEGQEFFYVFLTNPQGGAQIVEEKDDTGFAAFAMVIITGSDLHNGIIGFSEESQSGLELREG
AVMRRLHLIVTRQPNRAFEDVKVFWRVTLNKTVVVLQKDGVNLVEELQSVSGTTTCTMGQ
TKCFISIELKPEKVPQVEVYFFVELYEATAGAAINNSARFAQIKILESDESQSLVYFSVGSRLAV
```

TABLE 4-continued

Targets from which the Analogs are derived

AHKKATLISLQVARDSGTGLMMSVNFSTQELRSAETIGRTIISPAISGKDFVITEGTLVFEPGQR
STVLDVILTPETGSLNSFPKRFQIVLFDPKGGARIDKVYGTANITLVSDADSQAIWGLADQLH
QPVNDDILNRVLHTISMKVATENTDEQLSAMMHLIEKITTEGKIQAFSVASRTLFYEILCSLIN
PKRKDTRGFSHFAEVTENFAFSLLTNVTCGSPGEKSKTILDSCPYLSILALHWYPQQINGHKFE
GKEGDYIRIPERLLDVQDAEIMAGKSTCKLVQFTEYSSQQWFISGNNLPTLKNKVLSLSVKGQ
SSQLLTNDNEVLYRIYAAEPRIIPQTSLCLLWNQAAASWLSDSQFCKVVEETADYVECACSH
MSVYAVYARTDNLSSYNEAFFTSGFICISGLCLAVLSHIFCARYSMFAAKLLTHMMAASLGT
QILFLASAYASPQLAEESCSAMAAVTHYLYLCQFSWMLIQSVNFWYVLVMNDEHTERRYLL
FFLLSWGLPAFVVILLIVILKGIYHQSMSQIYGLIHGDLCFIPNVYAALFTAALVPLTCLVVVFV
VPIHAYQVKPQWKAYDDVFRGRTNAAEIPLILYLFALISVTWLWGGLHMAYRHFWMLVLF
VIFNSLQGLYVFMVYFILHNQMCCPMKASYTVEMNGHPGPSTAFFTPGSGMPPAGGEISKST
QNLIGAMEEVPPDWERASFQQGSQASPDLKPSPQNGATFPSSGGYGQGSLIADEESQEFDDLI
FALKTGAGLSVSDNESGQGSQEGGTLTDSQIVELRRIPIADTHL
(SEQ ID NO: 1252)

>gi|114205383|ref|NP_002971.2|secretin receptor precursor {Homo sapiens}
MRPHLSPPLQQLLLPVLLACAAHSTGALPRLCDVLQVLWEEQDQCLQELSREQTGDLGTEQP
VPGCEGMWDNISCWPSSVPGRMVEVECPRFLRMLTSRNGSLFRNCTQDGWSETFPRPNLAC
GVNVNDSSNEKRHSYLLKLKVMYTVGYSSSLVMLLVALGILCAFRRLHCTRNYIHMHLFVS
FILRALSNFIKDAVLFSSDDVTYCDAHRAGCKLVMVLFQYCIMANYSWLLVEGLYLHTLLAI
SFFSERKYLQGFVAFGWGSPAIFVALWAIARHFLEDVGCWDINANASIWWIIRGPVILSILINFI
LFINILRILMRKLRTQETRGNEVSHYKRLARSTLLLIPLFGIHYIVFAFSPEDAMEIQLFFELALG
SPQGLVVAVLYCFLNGEVQLEVQKKWQQWHLREFPLHPVASFSNSTKASHLEQSQGTCRTSII
(SEQ ID NO: 1253)

>gi|115387099|ref|NP_001694.2|brain-specific angiogenesis inhibitor 2 precursor {Homo sapiens}
MENTGWMGKGHRMTPACPLLLSVILSLRLATAFDPAPSACSALSGGVLYGAFSLQDLFPTIA
SGCSWTLENPDPTKYSLYLRFNRQEQVCAHFAPRLLPLDHYLVNFTCLRPSPEEAVAQAESE
VGRPEEEEAEAAAGLELCSGSGPFTFLHFDKNFVQLCLSAEPSEAPRLLAPAALAFRFVEVLLI
NNNNSSQFTCGVLCRWSEECGRAAGRACGFAQPGCSCPGEAGAGSTTTTSPGPPAAHTLSNA
LVPGGPAPPAEADLHSGSSNDLFTTEMRYGEEPEEEPKVKTQWPRSADEPGLYMAQTGDPA
AEEWSPWSVCSLTCGQGLQVRTRSCVSSPYGTLCSGPLRETRPCNNSATCPVHGVWEEWGS
WSLCSRSCGRGSRSRMRTCVPPQHGGKACEGPELQTKLCSMAACPVEGQWLEWGPWGPCS
TSCANGTQQRSRKCSVAGPAWATCTGALTDTRECSNLECPATDSKWGPWNAWSLCSKTCD
TGWQRRFRMCQATGTQGYPCEGTGEEVKPCSEKRCPAFHEMCRDEYVMLMTWKKAAAGE
IIYNKCPPNASGSASRRCLLSAQGVAYWGLPSFARCISHEYRYLYLSLREHLAKGQRMLAGE
GMSQVVRSLQELLARRTYYSGDLLFSVDILRNVTDTFKRATYVPSADDVQRFFQVVSFMVD
AENKEKWDDAQQVSPGSVHLLRVVEDFIHLVGDALKAFQSSLIVTDNLVISIQREPVSAVSSD
ITFPMRGRRGMKDWVRHSEDRLFLPKEVLSLSSPGKPATSGAAGSPGRGRGPGTVPPGPGHS
HQRLLPADPDESSVFVIGAVLYRTLGLILPPPRPPLAVTSRVMTVTVRPPTQPPAEPLITVELSY
IINGTTDPHCASWDYSRADASSGDWDTENCQTLETQAAHTRCQCQHLSTFAVLAQPPKDLTL
ELAGSPSVPLVIGCAVSCMALLTLLAIYAAFWRFIKSERSIILLNFCLSILASNILILVGQSRVLS
KGVCTMTAAFLHFFFLSSFCWVLTEAWQSYLAVIGRMRTRLVRKRFLCLGWGLPALVVAVS
VGFTRTKGYGTSSYCWLSLEGGLLYAFVGPAAVIVLVNMLIGIIVFNKLMARDGISDKSKKQ
RAGSERCPWASLLLPCSACGAVPSPLLSSASARNAMASLWSSCVVLPLLALTWMSAVLAMT
DRRSVLFQALFAVFNSAQGFVITAVHCFLRREVQDVVKCQMGVCRADESEDSPDSCKNGQL
QILSDFEKDVDLACQTVLFKEVNTCNPSTITGTLSRLSLDEDEEPKSCLVGPEGSLSFSPLPGNI
LVPMAASPGLGEPPPPQEANPVYMCGEGGLRQLDLTWLRPTEPGSEGDYMVLPRRTLSLQP
GGGGGGGEDAPRARPEGTPRRAAKTVAHTEGYPSFLSVDHSGLGLGPAYGSLQNPYGMTFQ
PPPPTPSARQVPEPGERSRTMPRTVPGSTMKMGSLERKKLRYSDLDFEKVMHTRKRHSELYH
ELNQKFHTFDRYRSQSTAKREKRWSVSSGGAAERSVCTDKPSPGERPSLSQHRRHQSWSTFK
SMTLGSLPPKRERLTLHRAAAWEPTEPPDGDFQTEV
(SEQ ID NO: 1254)

>gi|116063556|ref|NP_0171332.2|probable G-protein coupled receptor 88 {Homo sapiens}
MTNSSSTSTSSTTGGSLLLLCEEEESWAGRRIPVSLLYSGLAIGGTLANGMVIYLVSSFRKLQT
TSNAFIVNGCAADLSVCALWMPQEAVLGLLPTGSAEPPADWDGAGGSYRLLRGGLLGLGLT
VSLLSHCLVALNRYLLITRAPATYQALYQRRHTAGMLALSWALALGLVLLLPPWAPRPGAA
PPRVHYPALLAAAALLAQTALLLHCYLGIVRRVRVSVKRVSVLNFHLLHQLPGCAAAAAAF
PGAQHAPGPGGAAHPAQAQPLPPALHPRRAQRRLSGLSVLLLCCVFLLATQPLVWVSLASGF
SLPVPWGVQAASWLLCCALSALNPLLYTWRNEEFRRSVRSVLPGVGDAAAAAVAATAVPA
VSQAQLGTRAAGQHW
(SEQ ID NO: 1255)

>gi|116284382|ref|NP_001070662.1|G-protein coupled bile acid receptor 1 {Homo sapiens}
MTPNSTGEVPSPIPKGALGLSLALASLIITANLLLALGIAWDRRLRSPPAGCFFLSLLLAGLLTG
LALPTLPGLWNQSRRGYWSCLLVYLAPNFSFLSLLANLLLVHGERYMAVLRPLQPPGSIRLA
LLLTWAGPLLFASLPALGWNHWTPGANCSSQAIFPAPYLYLEVYGLLLPAVGAAAFLSVRVL
ATAHRQLQDICRLERAVCRDEPSALARALTWRQARAQAGAMLLFGLCWGPYVATLLLSVL
AYEQRPPLGPGTLLSLLSLGSASAAAVPVAMGLGDQRYTAPWRAAAQRCLQGLWGRASRD
SPGPSIAYHPSSQSSVDLDLN
(SEQ ID NO: 1256)

>gi|116517328|ref|NP_722580.3|probable G-protein coupled receptor 115 precursor {Homo sapiens}
MKMKSQATMICCLVFFLSTECSHYRSKIHLKAGDKLQSPEGKPKTGRIQEKCEGPCISSSNCS
QPCAKDFHGEIGFTCNQKKWQKSAETCTSLSVEKLFKDSTGASRLSVAAPSIPLHILDFRAPET
IESVAQGIRKNCPFDYACITDMVKSSETTSGNIAFIVELLKNISTDLSDNVTREKMKSYSEVAN
HILDTAAISNWAFIPNKNASSDLLQSVNLFARQLHIHNNSENIVNELFIQTKGFHINHNTSEKSL TABLE 4-continued Targets from which the Analogs are derived NFSMSMNNTTEDILGMVQIPRQELRKLWPNASQAISIAFPTLGAILREAHLQNVSLPRQVNGL
VLSVVLPERLQEIILTFEKINKTRNARAQCVGWHSKKRRWDEKACQMMLDIRNEVKCRCNY
TSVVMSFSILMSSKSMTDKVLDYITCIGLSVSILSLVLCLIIEATVWSRVVVTEISYMRHVCIVN
IAVSLLTANVWFIIGSHFNIKAQDYNMCVAVTFFSHFFYLSLFFWMLFKALLIIYGILVIFRRM
MKSRMMVIGFAIGYGCPLIIAVTTVAITEPEKGYMRPEACWLNWDNTKALLAFAIPAFVIVA
VNLIVVLVVAVNTQRPSIGSSKSQDVVIIMRISKNVAILTPLLGLTWGFGIATLIEGTSLTFHIIF
ALLNAFQGFFILLFGTIMDHKIRDALRMRMSSLKGKSRAAENASLGPTNGSKLMNRQG
(SEQ ID NO: 1257)

>gi|117940060|ref|NP_000905.3|opioid receptor, mu 1 isoform MOR-1 {Homo sapiens}
MDSSAAPTNASNCTDALAYSSCSPAPSPGSWVNLSHLDGNLSDPCGPNRTDLGGRDSLCPPT
GSPSMITAITIMALYSIVCVVGLFGNFLVMYVIVRYTKMKTATNIYIFNLALADALATSTLPFQ
SVNYLMGTWPFGTILCKIVISIDYYNMFTSIFTLCTMSVDRYIAVCHPVKALDFRTPRNAKIIN
VCNWILSSAIGLPVMFMATTKYRQGSIDCTLTFSHPTWYWENLLKICVFIFAFIMPVLIITVCY
GLMILRLKSVRMLSGSKEKDRNLRRITRMVLVVVAVFIVCWTPIHIYVIIKALVTIPETTFQTV
SWHFCIALGYTNSCLNPVLYAFLDENFKRCFREFCIPTSSNIEQQNSTRIRQNTRDHPSTANTV
DRTNHQLENLEAETAPLP
(SEQ ID NO: 1258)

>gi|119220588|ref|NP_115892.2|melanin-concentrating hormone receptor 2 {Homo sapiens}
MNPFHASCWNTSAELLNKSWNKEFAYQTASVVDTVILPSMIGIICSTGLVGNILIVFTIIRSRK
KTVPDIYICNLAVADLVHIVGMPFLIHQWARGGEWVFGGPLCTIITSLDTCNQFACSAIMTVM
SVDRYFALVQPFRLTRWRTRYKTIRINLGLWAASFILALPVWVYSKVIKFKDGVESCAFDLTS
PDDVLWYTLYLTITTFFFPLPLILVCYILILCYTWEMYQQNKDARCCNPSVPKQRVMKLTKM
VLVLVVVFILSAAPYHVIQLVNLQMEQPTLAFYVGYYLSICLSYASSSINPFLYILLSGNFQKR
LPQIQRRATEKEINNMGNTLKSHF >gi|119508433|ref|NP_005903.2|melanocortin receptor 4 {Homo sapiens}
MVNSTHRGMHTSLHLWNRSSYRLHSNASESLGKGYSDGGCYEQLFVSPEVFVTLGVISLLEN
ILVIVAIAKNKNLHSPMYFFICSLAVADMLVSVSNGSETIVITLLNSTDTDAQSFTVNIDNVIDS
VICSSLLASICSLLSIAVDRYFTIFYALQYHNIMTVKRVGIIISCIWAACTVSGILFIIYSDSSAVII
CLITMFFTMLALMASLYVHMFLMARLHIKRIAVLPGTGAIRQGANMKGAITLTILIGVFVVC
WAPFFLHLIFYISCPQNPYCVCFMSHFNLYLILIMCNSIIDPLIYALRSQELRKTFKEIICCYPLG
GLCDLSSRY
(SEQ ID NO: 1259)

>gi|119943116|ref|NP_001073328.1|G-protein coupled receptor 64 isoform 2 {Homo sapiens}
MVFSVRQCGHVGRTEEVLLTFKIFLVIICLHVVLVTSLEEDTDNSSLSPPPAKLSVVSFAPSSN
GTPEVETTSLNDVTLSLLPSNETGVKPQRNICNLSSICNDSAFFRGEIMFQYDKESTVPQNQHI
TNGTLTGVLSLSELKRSELNKTLQTLSETYFIMCATAEAQSTLNCTFTIKLNNTMNACAVIAA
LERVKIRPMEHCCCSVRIPCPSSPEELEKLQCDLQDPIVCLADHPRGPPFSSSQSIPVVPRATVL
SQVPKATSFAEPPDYSPVTHNVPSPIGEIQPLSPQPSAPIASSPAIDMPPQSETISSPMPQTHVSG
TPPPVKASFSSPTVSAPANVNTTSAPPVQTDIVNTSSISDLENQVLQMEKALSLGSLEPNLAGE
MINQVSRLLHSPPDMLAPLAQRLLKVVDDIGLQLNFSNTTISLTSPSLALAVIRVNASSFNTT
FVAQDPANLQVSLETQAPENSIGTITLPSSLMNNLPAHDMELASRVQFNFFETPALFQDPSLE
NLSLISYVISSSVANLTVRNLTRNVTVTLKHINPSQDELTVRCVFWDLGRNGGRGGWSDNGC
SVKDRRLNETICTCSHLTSFGVLLDLSRTSVLPAQMMALTFITYIGCGLSSIFLSVTLVTYIAFE
KIRRDYPSKILIQLCAALLLLNLVFLLDSWIALYKMQGLCIVKFLHYFLLVSFTWMGLEAF
HMYLALVKVFNTYIRKYILKFCIVGWGVPAVVVTIILTISPDNYGLGSYGKFPNGSPDDFCWI
NNNAVFYITVVGYFCVIFLLNVSMFIVVLVQLCRIKKKKQLGAQRKTSIQDLRSIAGLTFLLGI
TWGFAFFAWGPVNVTFMYLFAIFNTLQGFFIFIFYCVAKENVRKQWRRYLCCGKLRLAENSD
WSKTATNGLKKQTVNQGVSSSSNSLQSSSNSTNSTTLLVNNDCSVHASGNGNASTERNGVSF
SVQNGDVCLHDFTGKQHMFNEKEDSCNGKGRMALRRTSKRGSLHFIEQM
(SEQ ID NO: 1260)

>gi|125625352|ref|NP_055694.3|P2Y14 receptor {Homo sapiens}
MINSTSTQPPDESCSQNLLITQQIIPVLYCMVFIAGILLNGVSGWIFFYVPSSKSFIIYLKNIVIAD
FVMSLTFPPFKILGDSGLGPWQLNVFVCRVSAVLFYVNMYVSIVFFGLISFDRYYKIVKPLWTS
FIQSVSYSKLLSVIVWMLMLLLAVPNIILTNQSVREVTQIKCIELKSELGRKWHKASNYIFVAI
FWIVFLLLIVFYTAITKKIFKSHLKSSRNSTSVKKKSSRNIFSIVFVFFVCFVPYHIARIPYTKSQT
EAHYSCQSKEILRYMKEFTLLLSAANVCLDPIIYFFLCQPFREILCKKLHIPLKAQNDLDISRIK
RGNTTLESTDTL
(SEQ ID NO: 1261)

>gi|125660451|ref|NP_671732.3|MAS-related GPR, member X1 {Homo sapiens}
MDPTISTLDTELTPINGTEETLCYKQTLSLTVLTCIVSLVGLTGNAVVLWLLGCRMRRNAFSI
YILNLAAADFLFLSGRLIYSLLSFISIPHTISKILYPVMMFSYFAGLSFLSAVSTERCLSVLWPIW
YRCHRPTHLSAVVCVLLWALSLLRSILEWMLCGFLFSGADSAWCQTSDFITVAWLIFLCVVL
CGSSLVLLIRILCGSRKIPLTRLYVTILLTVLVFLLCGLPFGIQFFLFLWIHVDREVLFCHVHLVS
IFLSALNSSANPIIYFFVGSFRQRQNRQNLKLVLQRALQDASEVDEGGGQLPEEILELSGSRLEQ
(SEQ ID NO: 1262)

>gi|133930786|ref|NP_115960.2|EGF-like module-containing mucin-like hormone receptor-like 3
{Homo sapiens}
MQGPLLLPGLCFLLSLFGAVTQKTKTSCAKCPPNASCVNNTHCTCNHGYTSGSGQKLFTFPL
ETCNDINECTPPYSVYCGFNAVCYNVEGSFYQCPVPGYRLHSGNEQFSNSNENTCQDTTSSK
TTEGRKELQKIVDKFESLLTNQTLWRTEGRQEISSTATTILRDVESKVLETALKDPEQKVLKIQ
NDSVAIETQAITDNCSEERKTFNLNVQMNSMDIRCSDIIQGDTQGPSAIAFISYSSLGNIINATF TABLE 4-continued Targets from which the Analogs are derived

```
FEEMDKKDQVYLNSQVVSAAIGPKRNVSLSKSVTLTFQHVKMTPSTKKVFCVYWKSTGQGS
QWSRDGCFLIHVNKSHTMCNCSHLSSFAVLMALTSQEEDPVLTVITYVGLSVSLLCLLLAAL
TFLLCKAIRNTSTSLHLQLSLCLFLAHLLFLVGIDRTEPKVLCSIIAGALHYLYLAAFTWMLLE
GVHLFLTARNLTVVNYSSINRLMKWIMFPVGYGVPAVTVAISAASWPHLYGTADRCWLHLD
QGFMWSFLGPVCAIFSANLVLFILVFWILKRKLSSLNSEVSTIQNTRMLAFKATAQLFILGCT
WCLGLLQVGPAAQVMAYLFTIINSLQGFFIFLVYCLLSQQVQKQYQKWFREIVKSKSESETY
TLSSKMGPDSKPSEGDVFPGQVKRKY
(SEQ ID NO: 1263)

>gi|134244291|ref|NP_004758.3|endothelin B receptor-like protein 2 precursor {Homo sapiens}
MRWLWPLAVSLAVILAVGLSRVSGGAPLHLGRHRAETQEQQSRSKRGTEDEEAKGVQQYV
PEEWAEYPRPIHPAGLQPTKPLVATSPNPGKDGGTPDSGQELRGNLTGAPGQRLQIQNPLYPV
TESSYSAYAIMLLALVVFAVGIVGNLSVMCIVWHSYYLKSAWNSILASLALWDFLVLFFCLPI
VIFNEITKQRLLGDVSCRAVPFMEVSSLGVTTFSLCALGIDRFHVATSTLPKVRPIERCQSILAK
LAVIWVGSMTLAVPELLLWQLAQEPAPTMGTLDSCIMKPSASLPESLYSLVMTYQNARMW
WYFGCYFCLPILFTVTCQLVTWRVRGPPGRKSECRASKHEQCESQLNSTVVGLTVVYAFCTL
PENVCNIVVAYLSTELTRQTLDLLGLINQFSTFFKGAITPVLLLCICRPLGQAFLDCCCCCCCE
ECGGASEASAANGSDNKLKTEVSSSIYFHKPRESPPLLPLGTPC
(SEQ ID NO: 1264)

>gi|134244587|ref|NP_004221.3|endothelial differentiation, sphingolipid G-protein-coupled receptor,
5 {Homo sapiens}
MGSLYSEYLNPNKVQEHYNYTKETLETQETTSRQVASAFIVILCCAIVVENLLVLIAVARNSK
FHSAMYLFLGNLAASDLLAGVAFVANTLLSGSVTLRLTPVQWFAREGSAFITLSASVFSLLAI
AIERHVAIAKVKLYGSDKSCRMLLLIGASWLISLVLGGLPILGWNCLGHLEACSTVLPLYAKH
YVLCVVTIFSIILLAIVALYVRIYCVVRSSHADMAAPQTLALLKTVTIVLGVFIVCWLPAFSILL
LDYACPVHSCPILYKAHYFFAVSTLNSLLNPVIYTWRSRDLRREVLRPLQCWRPGVGVQGRR
RGGTPGHHLLPLRSSSSLERGMHMPTSPTFLEGNTVV
(SEQ ID NO: 1265)

>gi|134288847|ref|NP_722581.4|probable G-protein coupled receptor 111 {Homo sapiens}
MTHILLLYYLVFLLPTESCRTLYQAASKSKEKVPARPHGVCDGVCTDYSQCTQPCPPDTQGN
MGFSCRQKTWHKITDTCQTLNALNIFEEDSRLVQPFEDNIKISVYTGKSETITDMLLQKCPTD
LSCVIRNIQQSPWIPGNIAVIVQLLHNISTAIWTGVDEAKMQSYSTIANHILNSKSISNWTFIPD
RNSSYILLHSVNSFARRLFIDKHPVDISDVFIHTMGTTISGDNIGKNFTFSMRINDTSNEVTGRV
LISRDELRKVPSPSQVISIAFPTIGAILEASLLENVTVNGLVLSALPKELKRISLIFEKISKSEERR
TQCVGWHSVENRWDQQACKMIQENSQQAVCKCRPSKLFTSFSILMSPHILESLILTYITYVGL
GISICSLILCLSIEVLVWSQVTKTEITYLRHVCIVNIAATLLMADVWFIVASFLSGPITHHKGCV
AATFFVHFFYLSVFFWMLAKALLILYGIMIVFHTLPKSVLVASLFSVGYGCPLAIAAITVAATE
PGKGYLRPEICWLNWDMTKALLAFVIPALAIVVVNLITVTLVIVKTQRAAIGNSMFQEVRAIV
RISKNIAILTPLLGLTWGFGVATVIDDRSLAFHIIFSLLNAFQGFFILVFGTILDPKIREALKG
(SEQ ID NO: 1266)

>gi|141802362|ref|NP_722577.2|probable G-protein coupled receptor 113 isoform 3 {Homo sapiens}
MTTRKLSAHSAATPGYKAVTHKHHTGWARMAKTGLPEKGQSQAGGESGSGQLLDQENGA
GESALVSVYVHLDEPDKTWPPELSRTLTLPAASASSSPRPLLTGLRLTTGEYMSCFEAQGFKW
NLYEVVRVPLKATDVARLPYQLSISCATSPGFQLSCCIPSTNLAYTAAWSPGEGSKASSFNES
GSQCFVLAVQRCPMADTTYACDLQSLGLAPLRVPISITIIQDGDITCPEDASVLTWNVTKAGH
VAQAPCPESKRGIVRRLCGADGVWGPVHSSCTDARLLALFTRTKLLQAGQGSPAEEVPQILA
QLPGQAAEASSPSDLLTLLSTMKYVAKVVAEARIQLDRRALKNLLIATDKVLDMDTRSLWT
LAQARKPWAGSTLLLAVETLACSLCPQDHPFAFSLPNVLLQSQLFGPTFPADYSISFPTRPPLQ
AQIPRHSLAPLVRNGTEISITSLVLRKLDHLLPSNYGQGLGDSLYATPGLVLVISIMAGDRAFS
QGEVIMDFGNTDGSPHCVFWDHSLFQGRGGWSKEGCQAQVASASPTAQCLCQHLTAFSVL
MSPHTVPEEPALALLTQVGLGASILALLVCLGVYWLVWRVVVRNKISYFRHAALLNMVFCL
LAADTCFLGAPFLSPGPRSPLCLAAAFLCHFLYLATFFWMLAQALVLAHQLLFVFHQLAKHR
VLPLMVLLGYLCPLGLAGVTLGLYLPQGQYLREGECWLDGKGGALYTFVGPVLAIIGVNGL
VLAMAMLKLLRPSLSEGPPAEKRQALLGVIKALLILTPIFGLTWGLGLATLLEEVSTVPHYIFT
ILNTLQGVFILLFGCLMDRKIQEALRKRFCRAQAPSSTISLATNEGCILEHSKGGSDTARKTDA
SE
(SEQ ID NO: 1267)

>gi|144922665|ref|NP_001077378.1|probable G-protein coupled receptor 123 {Homo sapiens}
MDLKTVLSLPRYPGEFLHPVVYACTAVMLLCLLASFVTYIVHQSAIRISRKGRHTLLNFCFHA
ALTFTVFAGGINRTKYPILCQAVGIVLHYSTLSTMLWIGVTARNIYKQVTKKAPLCLDTDQPP
YPRQPLLRFYLVSGGVPFIICGVTAATNIRNYGTEDEDTAYCVMAWEPSLGAFYGPAAIITLV
TCVYFLGTYVQLRRHPGRRYELRTQPEEQRRLATPEGGRGIRPGTPPAHDAPGASVLQNEHS
FQAQLRAAAFTLFLFTATWAFGALAVSQGHFLDMVFSCLYGAFCVTLGLFVLIHHCAKRED
VWQCWWACCPPRKDAHPALDANGAALGRAACLHSPGLGQPRGFAHPPGPCKMTNLQAAQ
GHASCLSPATPCCAKMHCEPLTADEAHVHLQEEGAFGHDPHLHGCLQGRTKPPYFSRHPAE
EPEYAYHIPSSLDGSPRSSRTDSPPSSLDGPAGTHTLACCTQGDPFPMVTQPEGSDGSPALYSC
PTQPGREAALGPGHLEMLRRTQSLPFGGPSQNGLPKGKLLEGLPFGTDGTGNIRTGPWKNET
TV
(SEQ ID NO: 1268)

>gi|145309304|ref|NP_001398.2|cadherin EGF LAG seven-pass G-type receptor 3 precursor {Homo
sapiens}
MMARRPPWRGLGGRSTPILLLLLLSLFPLSQEELGGGHQGWDPGLAATTGPRAHIGGGALA
LCPESSGVREDGPGLGVREPIFVGLRGRRQSARNSRGPPEQPNEELGIEHGVQPLGSRERET
```

TABLE 4-continued

Targets from which the Analogs are derived

```
GQGPGSVLYWRPEVSSCGRTGPLQRGSLSPGALSSGVPGSGNSSPLPSDFLIRHHGPKPVSSQ
RNAGTGSRKRVGTARCCGELWATGSKGQGERATTSGAERTAPRRNCLPGASGSGPELDSAP
RTARTAPASGSAPRESRTAPEPAPKRMRSRGLFRCRFLPQRPGPRPPGLPARPEARKVTSANR
ARFRRAANRHPQFPQYNYQTLVPENEAAGTAVLRVVAQDPDAGEAGRLVYSLAALMNSRS
LELFSIDPQSGLIRTAAALDRESMERHYLRVTAQDHGSPRLSATTMVAVTVADRNDHSPVFE
QAQYRETLRENVEEGYPILQLRATDGDAPPNANLRYRFVGPPAARAAAAAAFEIDPRSGLIST
SGRVDREHMESYELVVEASDQGQEPGPRSATVRVHITVLDENDNAPQFSEKRYVAQVREDV
RPHTVVLRVTATDRDKDANGLVHYNIISGNSRGHFAIDSLTGEIQVVAPLDFEAEREYALRIR
AQDAGRPPLSNNTGLASIQVVDINDHIPIFVSTPFQVSVLENAPLGHSVIHIQAVDADHGENAR
LEYSLTGVAPDTPFVINSATGWVSVSGPLDRESVEHYFFGVEARDHGSPPLSASASVTVTVLD
VNDNRPEFTMKEYHLRLNEDAAVGTSVVSVTAVDRDANSAISYQITGGNTRNRFAISTQGGV
GLVTLALPLDYKQERYFKLVLTASDRALHDHCYVHINITDANTHRPVFQSAHYSVSVNEDRP
MGSTIVVISASDDDVGENARITYLLEDNLPQFRIDADSGAITLQAPLDYEDQVTYTLAITARD
NGIPQKADTTYVEVMVNDVNDNAPQFVASHYTGLVSEDAPPFTSVLQISATDRDAHANGRV
QYTFQNGEDGDGDFTIEPTSGIVRTVRRLDREAVSVYELTAYAVDRGVPPLRTPVSIQVMVQ
DVNDNAPVFPAEEFEVRVKENSIVGSVVAQITAVDPDEGPNAHIMYQIVEGNIPELFQMDIFS
GELTALIDLDYEARQEYVIVVQATSAPLVSRATVHVRLVDQNDNSPVLNNFQILFNNYVSNR
SDTFPSGIIGRIPAYDPDVSDHLFYSFERGNELQLLVVNQTSGELRLSRKLDNNRPLVASMLVT
VTDGLHSVTAQCVLRVVIITEELLANSLTVRLENMWQERFLSPLLGRFLEGVAAVLATPAED
VFIFNIQNDTDVGGTVLNVSFSALAPRGAGAGAAGPWFSSEELQEQLYVRRAALAARSLLDV
LPFDDNVCLREPCENYMKCVSVLRFDSSAPFLASASTLFRPIQPIAGLRCRCPPGFTGDFCETE
LDLCYSNPCRNGGACARREGGYTCVCRPRFTGEDCELDTEAGRCVPGVCRNGGTCTDAPNG
GFRCQCPAGGAFEGPRCEVAARSFPPSSFVMFRGLRQRFHLTLSLSFATVQQSGLLFYNGRLN
EKHDFLALELVAGQVRLTYSTGESNTVVSPTVPGGLSDGQWHTVHLRYYNKPRTDALGGA
QGPSKDKVAVLSVDDCDVAVALQFGAEIGNYSCAAAGVQTSSKKSLDLTGPLLLGGVPNLP
ENFPVSHKDFIGCMRDLHIDGRRVDMAAFVANNGTMAGCQAKLHFCDSGPCKNSGFCSER
WGSFSCDCPVGFGGKDCQLTMAHPHHFRGNGTLSWNFGSDMAVSVPWYLGLAFRTRATQG
VLMQVQAGPHSTLLCQLDRGLLSVTVTRGSGRASHLLLDQVTVSDGRWHDLRLELQEEPGG
RRGHHVLMVSLDFSLFQDTMAVGSELQGLKVKQLHVGGLPPGSAEEAPQGLVGCIQGVWL
GSTPSGSPALLPPSHRVNAEPGCVVTNACASGPCPPHADCRDLWQTFSCTCQPGYYGPGCVD
ACLLNPCQNQGSCRHLPGAPHGYTCDCVGGYFGHHCEHRMDQQCPRGWWGSPTCGPCNC
DVHKGFDPNCNKTNGQCHCKEFHYRPRGSDSCLPCDCYPVGSTSRSCAPHSGQCPCRPGAL
GRQCNSCDSPFAEVTASGCRVLYDACPKSLRSGVWWPQTKFGVLATVPCPRGALGAAVRLC
DEAQGWLEPDLFNCTSPAFRELSLLLDGLELNKTALDTMEAKKLAQRLREVTGHTDHYFSQ
DVRVTARLLAHLLAFESHQQGFGLTATQDAHFNENLLWAGSALLAPETGDLWAALGQRAP
GGSPGSAGLVRHLEEYAATLARNMELTYLNPMGLVTPNIMLSIDRMEHPSSPRGARRYPRYH
SNLFRGQDAWDPHTHVLLPSQSPRPSPSEVLPTSSSIENSTTSSVVPPPAPPEPEPGISIIILLVYR
TLGGLLPAQFQAERRGARLPQNPVMNSPVVSVAVFHGRNFLRGILESPISLEFRLLQTANRSK
AICVQWDPPGLAEQHGVWTARDCELVHRNGSHARCRCSRTGFGVLMDASPRERLEGDLEL
LAVFTHVVVAVSVAALVLTAAILLSLRSLKSNVRGIHANVAAALGVAELLFLLGIHRTHNQL
VCTAVAILLHYFFLSTFAWLFVQGLHLYRMQVEPRNVDRGAMRFYHALGWGVPAVLLGLA
VGLDPEGYGNPDFCWISVHEPLIWSFAGPVVLVIVMNGTMFLLAARTSCSTGQREAKKTSAL
TLRSSFLLLLLVSASWLFGLLAVNHSILAFHYLHAGLCGLQGLAVLLLFCVLNADARAAWM
PACLGRKAAPEEARPAPGLGPGAYNNTALFEESGLIRITLGASTVSSVSSARSGRTQDQDSQR
GRSYLRDNVLVRHGSAADHTDHSLQAHAGPTDLDVAMFHRDAGADSDSDSDLSLEEERSLS
IPSSESEDNGRTRGRFQRPLCRAAQSERLLTHPKDVDGNDLLSYWPALGECEAAPCALQTWG
SERRLGLDTSKDAANNNQPDPALTSGDETSLGRAQRQRKGILKNRLQYPLVPQTRGAPELSW
CRAATLGHRAVPAASYGRIYAGGGTGSLSQPASRYSSREQLDLLLRRQLSRERLEEAPAPVL
RPLSRPGSQECMDAAPGRLEPKDRGSTLPRRQPPRDYPGAMAGRFGSRDALDLGAPREWLS
TLPPPRRTRDLDPQPPPLPLSPQRQLSRDPLLPSRPLDSLSRSSNSREQLDQVPSRHPSREALGP
LPQLLRAREDSVSGPSHGPSTEQLDILSSILASFNSSALSSVQSSSTPLGPHTTATPSATASVLGP
STPRSATSHSISELSPDSEVPRSEGHS
(SEQ ID NO: 1269)

>gi|145309315|ref|NP_543141.3|probable G-protein coupled receptor 62 {Homo sapiens}
MANSTGLNASEVAGSLGLILAAVVEVGALLGNGALLVVVLRTPGLRDALYLAHLCVVDLLA
AASIMPLGLLAAPPPGLGRVRLGPAPCRAARFLSAALLPACTLGVAALGLARYRLIVHPLRPG
SRPPPVLVLTAVWAAAGLLGALSLLGTPPAPPPAPARCSVLAGGLGPFRPLWALLAFALPAL
LLLGAYGGIFVVARRAALRPPRPARGSRLHSDSLDSRLSILPPLRPRLPGGKAALAPALAVGQ
FAACWLPYGCACLAPAARAAEAEAAVTWVAYSAFAAHPFLYGLLQRPVRLALGRLSRRAL
PGPVRACTPQAWHPRALLQCLQRPPEGPAVGPSEAPEQTPELAGGRSPAYQGPPESSLS
(SEQ ID NO: 1270)

>gi|148664220|ref|NP_659452.3|mas-related G-protein coupled receptor member F {Homo sapiens}
MAGNCSWEAHPGNRNKMCPGLSEAPELYSRGFLTIEQIAMLPPPAVMNYIFLLLCLCGLVGN
GLVLWFFGFSIKRNPFSIYFLHLASADVGYLFSKAVFSILNTGGFLGTFADYIRSVCRVLGLCM
FLTGVSLLPAVSAERCASVIFPPAWYWRRRPKRLSAVVCALLWVLSLLVTCLHNYFCVFLGRG
APGAACRHMDIFLGILLFLLCCPLMVLPCLALILHVECRARRRQRSAKLNHVILAMVSVFLVS
SIYLGIDWFLFWVFQIPAPFPEYVTDLCICINSSAKPIVYFLAGRDKSQRLWEPLRVVFQRALR
DGAELGEAGGSTPNTVTMEMQCPPGNAS
(SEQ ID NO: 1271)

>gi|148719673|ref|NP_056049.4|probable G-protein coupled receptor 116 precursor {Homo sapiens}
MKSPRRTTLCLMFIVIYSSKAALNWNYESTIHPLSLHEHEPAGEEALRQKRAVATKSPTAEEY
TVNIEISFENASFLDPIKAYLNSLSFPIHGNNTDQITDLSINVTTVCRPAGNEIWCSCETGYGW
PRERCLHNLICQERDVFLPGHHCSCLKELPPNGPFCLLQEDVTLNMRVRLNVGFQEDLMNTS
SALYRSYKTDLETAFRKGYGILPGFKGVTVTGFKSGSVVVTYEVKTTPPSLELIHKANEQVV
QSLNQTYKMDYNSFQAVTINESNFFVTPEIIFEGDTVSLVCEKEVLSSNVSWRYEEQQLEIQN
```

TABLE 4-continued

Targets from which the Analogs are derived

```
SSRFSIYTALFNNMTSVSKLTIHNITPGDAGEYVCKLILDIFEYECKKKIDVMPIQILANEEMKV
MCDNNPVSLNCCSQGNVNWSKVEWKQEGKINIPGTPETDIDSSCSRYTLKADGTQCPSGSSG
TTVIYTCEFISAYGARGSANIKVTFISVANLTITPDPISVSEGQNFSIKCISDVSNYDEVYWNTS
AGIKIYQRFYTTRRYLDGAESVLTVKTSTREWNGTYHCIFRYKNSYSIATKDVIVHPLPLKLNI
MVDPLEATVSCSGSHHIKCCIEEDGDYKVTFHTGSSSLPAAKEVNKKQVCYKHNFNASSVS
WCSKTVDVCCHFTNAANNSVWSPSMKLNLVPGENITCQDPVIGVGEPGKVIQKLCRFSNVPS
SPESPIGGTITYKCVGSQWEEKRNDCISAPINSLLQMAKALIKSPSQDEMLPTYLKDLSISIDKA
EHEISSSPGSLGAIINILDLLSTVPTQVNSEMMTHVLSTVNVILGKPVLNTWKVLQQQWTNQS
SQLLHSVERFSQALQSGDSPPLSFSQTNVQMSSMVIKSSHPETYQQRFVFPYFDLWGNVVIDK
SYLENLQSDSSIVTMAFPTLQAILAQDIQENNFAESLVMTTTVSHNTTMPFRISMTFKNNSPSG
GETKCVFWNFRLANNTGGWDSSGCYVEEGDGDNVTCICDHLTSFSILMSPDSPDPSSLLGILL
DIISYVGVGFSILSLAACLVVEAVVWKSVTKNRTSYMRHTCIVNIAASLLVANTWFIVVAAIQ
DNRYILCKTACVAATFFIHFFYLSVFFWMLTLGLMLFYRLVPILHETSRSTQKAIAFCLGYGC
PLAISVITLGATQPREVYTRKNVCWLNWEDTKALLAFAIPALIIVVVNITITIVVITKILRPSIGD
KPCKQEKSSLFQISKSIGVLTPLLGLTWGFGLTTVFPGTNLVFHIIFAILNVFQGLFILLFGCLW
DLKVQEALLNKFSLSRWSSQHSKSTSLGSSTPVFSMSSPISRRFNNLFGKTGTYNVSTPEATSS
SLENSSSASSLLN
(SEQ ID NO: 1272)

>gi|148806925|ref|NP_071442.2|EGF, latrophilin and seven transmembrane domain containing 1
precursor {Homo sapiens}
MKRLPLLVVFSTLLNCSYTQNCTKTPCLPNAKCEIRNGIEACYCNMGFSGNGVTICEDDNEC
GNLTQSCGENANCTNTEGSYYCMCVPGFRSSSNQDRFITNDGTVCIENVNANCHLDNVCIAA
NINKTLTKIRSIKEPVALLQEVYRNSVTDLSPTDIITYIEILAESSSLLGYKNNTISAKDTLSNST
LTEFVKTVNNFVQRDTFVVWDKLSVNHRRTHLTKLMHTVEQATLRISQSFQKTTEFDTNSTD
IALKVFFFDSYNMKHIHPHMNMDGDYINIFPKRKAAYDSNGNVAVAFVYYKSIGPLLSSSDN
FLLKPQNYDNSEEEERVISSVISVSMSSNPPTLYELEKITFTLSHRKVTDRYRSLCAFWNYSPD
TMNGSWSSEGCELTYSNETHTSCRCNHLTHFAILMSSGPSIGIKDYNILTRITQLGIIISLICLAIC
IFTFWFFSEIQSTRTTIHKNLCCSLFLAELVFLVGINTNTNKLFCSIIAGLLHYFFLAAFAWMCIE
GIHLYLIVVGVIYNKGFLHKNFYIFGYLSPAVVVGFSAALGYRYYGTTKVCWLSTENNFIWSF
IGPACLIILVNLLAFGVIIYKVFRHTAGLKPEVSCFENIRSCARGALALLFLLGTTWIFGVLHVV
HASVVTAYLFTVSNAFQGMFIFLFLCVLSRKIQEEYYRLFKNVPCCFGCLR
(SEQ ID NO: 1273)

>gi|149944554|ref|NP_001043.2|somatostatin receptor type 4 {Homo sapiens}
MSAPSTLPPGGEEGLGTAWPSAANASSAPAEAEEAVAGPGDARAAGMVAIQCIYALVCLVG
LVGNALVIFVILRYAKMKTATNIYLLNLAVADELFMLSVPFVASSAALRHWPFGSVLCRAVL
SVDGLNMFTSVFCLTVLSVDRYVAVVHPLRAATYRRPSVAKLINLGVWLASLLVTLPIAIFA
DTRPARGGQAVACNLQWPHPAWSAVFVVYTFLLGFLLPVLAIGLCYLLIVGKMRAVALRAG
WQQRRSEKKITRLVLMVVVVFVLCWMPFYVVQLLNLFVTSLDATVNHVSLILSYANSCAN
PILYGFLSDNFRRFFQRVLCLRCCLLEGAGGAEEEPLDYYATALKSKGGAGCMCPPLPCQQE
ALQPEPGRKRIPLTRTTTF
(SEQ ID NO: 1274)

>gi|150170722|ref|NP_004215.2|G protein-coupled receptor 50 {Homo sapiens}
MGPTLAVPTPYGCIGCKLPQPEYPPALIIFMFCAMVITIVVDLIGNSMVILAVTKNKKLRNSGN
IFVVSLSVADMLVAIYPYPLMLHAMSIGGWDLSQLQCQMVGFITGLSVVGSIFNIVAIAINRY
CYICHSLQYERIFSVRNTCIYLVITWIMTVLAVLPNMYIGTIEYDPRTYTCIFNYLNNPVTVTI
VCIHFVLPLLIVGFCYVRIWTKVLAARDPAGQNPDNQLAEVRNFLTMFVIFLLFAVCWCPINV
LTVLVAVSPKEMAGKIPNWLYLAAYFIAYFNSCLNAVIYGLLNENFRREYWTIFHAMRHPIIF
FSGLISDIREMQEARTLARARAHARDQAREQDRAHACPAVEETPMNVRNVPLPGDAAAGHP
DRASGHPKPHSRSSSAYRKSASTHHKSVFSHSKAASGHLKPVSGHSKPASGHPKSATVYPKP
ASVHFKADSVHFKGDSVHFKPDSVHFKPASSNPKPITGHHVSAGSHSKSAFSAATSHPKTTG
HIKPATSHAEPTTADYPKPATTSHPKPTAADNPELSASHCPEIPAIAHPVSDDSDLPESASSPAA
GPTKPAASQLESDTIADLPDPTVVTTSTNDYHDVVVIDVEDDPDEMAV
(SEQ ID NO: 1275)

>gi|153791424|ref|NP_004769.2|putative G-protein coupled receptor 44 {Homo sapiens}
MSANATLKPLCPILEQMSRLQSHSNTSIRYIDHAAVLLHGLASLLGLVENGVILFVVGCRMRQ
TVVTTWVLHLALSDLLASASLPFFTYFLAVGHSWELGTTFCKLHSSIFFLNMFASGFLLSAISL
DRCLQVVRPVWAQNHRTVAAAHKVCLVLWALAVLNTVPYFVFRDTISRLDGRIMCYYNVL
LLNPGPDRDATCNSRQVALAVSKFLLAFLVPLAIIASSHAAVSLRLQHRGRRRPGRFVRLVAA
VVAAFALCWGPYHVFSLLEARAHANPGLRPLVWRGLPFVTSLAFFNSVANPVLYVLTCPDM
LRKLRRSLRTVLESVLVDDSELGGAGSSRRRRTSSTARSASPLALCSRPEEPRGPARLLGWLL
GSCAASPQTGPLNRALSSTSS
(SEQ ID NO: 1276)

>gi|153792268|ref|NP_005290.2|probable G-protein coupled receptor 31 {Homo sapiens}
MPFPNCSAPSTVVATAVGVLLGLECGLGLLGNAVALWTFLFRVRVWKPYAVYLLNLALAD
LLLAACLPFLAAFYLSLQAWHLGRVGCWALHFLLDLSRSVGMAFLAAVALDRYLRVVHPR
LKVNLLSPQAALGVSGLVWLLMVALTCPGLLISEAAQNSTRCHSFYSRADGSFSIIWQEALSC
LQFVLPFGLIVFCNAGIIRALQKRLREPEKQPKLQRAQALVTLVVVLFALCFLPCFLARVLMHI
FQNLGSCRALCAVAHTSDVTGSLTYLHSVLNPVVYCFSSPTFRSSYRRVFHTLRGKGQAAEP
PDFNPRDSYS
(SEQ ID NO: 1277)
```

TABLE 4-continued

Targets from which the Analogs are derived

>gi|156104886|ref|NP_057686.2|C-C chemokine receptor type 10 {Homo sapiens}
MGTEATEQVSWGHYSGDEEDAYSAEPLPELCYKADVQAFSRAFQPSVSLTVAALGLAGNGL
VLATHLAARRAARSPTSAHLLQLALADLLLALTLPFAAAGALQGWSLGSATCRTISGLYSAS
FHAGFLFLACISADRYVAIARALPAGRPSTPGRAHLVSIVWLLSLLLALPALLFSQDGQRE
GQRRCRLIFPEGLTQTVKGASAVAQVALGFALPLGVMVACYALLGRTLLAARGPERRRALR
VVVALVAAFVVLQLPYSLALLLDTADLLAARERSCPASKRKDVALLVTSGLALARCGLNPV
LYAFLGLRFRQDLRRLLRGGSCPSGPQPRRGCPRRPRLSSCSAPTETHSLSWDN
(SEQ ID NO: 1278)

>gi|157364957|ref|NP_005963.3|neuropeptide Y receptor type 4 {Homo sapiens}
MNTSHLLALLLPKSPQGENRSKPLGTPYNFSEHCQDSVDVMFIVTSYSIETVVGVLGNLCL
MCVTVRQKEKANVTNLLIANLAFSDFLMCLLCQPLTAVYTIMDYWIFGETLCKMSAFIQCMS
VTVSILSLVLVALERHQLIINPTGWKPSISQAYLGIVLIWVIACVLSLPFLANSILENVFHKNHS
KALEFLADKVVCTESWPLAHHRTIYTTFLLLFQYCLPLGFILVCYARIYRRLQRQGRVFHKGT
YSLRAGHMKQVNVVLVVMVVAFAVLWLPLHVFNSLEDWHHEAIPICHGNLIFLVCHLLAM
ASTCVNPFIYGFLNTNFKKEIKALVLTCQQSAPLEESEHLPSTVHTEVSKGSLRLSGRSNPI
(SEQ ID NO: 1279)

>gi|157426873|ref|NP_001048.2|substance-K receptor {Homo sapiens}
MGTCDIVTEANISSGPESNTTGITAFSMPSWQLALWATAYLALVLVAVTGNAIVIWIILAHRR
MRTVTNYFIVNLALADLCMAAFNAAFNFVYASHNIWYFGRAFCYFQNLFPITAMFVSIYSMT
AIAADRYMAIVHPFQPRLSAPSTKAVIAGIWLVALALASPQCFYSTVTMDQGATKCVVAWPE
DSGGKTLLLYHLVVIALIYFLPLAVMFVAYSVIGLTLWRRAVPGHQAHGANLRHLQAMKKF
VKTMVLVVLTFAICWLPYHLYFILGSFQEDIYCHKFIQQVYLALFWLAMSSTMYNPIIYCCLN
HRFRSGFRLAFRCCPWVTPTKEDKLELTPTTSLSTRVNRCHTKETLFMAGDTAPSEATSGEA
GRPQDGSGLWFGYGLLAPTKTHVEI
(SEQ ID NO: 1280)

>gi|157671951|ref|NP_005061.2|anion exchange protein 3 isoform 1 {Homo sapiens}
MANGVIPPPGGASPLPQVRVPLEEPPLSPDVEEEDDDLGKTLAVSRFGDLISKPPAWDPEKPS
RSYSERDFEFHRHTSHHTHHPLSARLPPPHKLRRLPPTSARHTRRKRKKEKTSAPPSEGTPPIQ
EEGGAGVDEEEEEEEEEGESEAEPVEPPPSGTPQKAKFSIGSDEDDSPGLPGRAAVTKPLPSV
GPHTDKSPQHSSSSPSPRARASRLAGEKSRPWSPSASYDLRERLCPGSALGNPGGPEQQVPTD
EAEAQMLGSADLDDMKSHRLEDNPGVRRHLVKKPSRTQGGRGSPSGLAPILRRKKKKKLD
RRPHEVFVELNELMLDRSQEPHWRETARWIKFEEDVEEETERWGKPHVASLSFRSLLELRRTI
AHGAALLDLEQTTLPGIAHLVVETMIVSDQIRPEDRASVLRTLLLKHSHPNDDKDSGFFPRNP
SSSSMNSVLGNHHPTPSHGPDGAVPTMADDLGEPAPLWPHDPDAKEKPLHMPGGDGHRGK
SLKLLEKIPEDAEATVVLVGCVPFLEQPAAAFVRLNEAVLLESVLEVPVPVRFLFVMLGPSHT
STDYHELGRSIATLMSDKLFHEAAYQADDRQDLLSAISEFLDGSIVIPPSEVEGRDLLRSVAAF
QRELLRKRREREQTKVEMTTRGGYTAPGKELSLELGGSEATPEDDPLLRTGSVFGGLVRDVR
RRYPHYPSDLRDALHSQCVAAVLFIYFAALSPAITFGGLLGEKTEGLMGVSELIVSTAVLGVL
FSLLGAQPLLVVGFSGPLLVFEEAFFKFCRAQDLEYLTGRVWVGLWLVVFVLALVAAEGSFL
VRYISPFTQEIFAFLISLIFIYETFYKLYKVFTEHPLLPFYPPEGALEGSLDAGLEPNGSALPPTE
GPPSPRNQPNTALLSLILMLGTFFIAFFLRKFRNSRFLGGKARRIIGDFGIPISILVMVLVDYSIT
DTYTQKLTVPTGLSVTSPDKRSWFIPPLGSARPFPPWMMVAAAVPALLVLILIFMETQITALIV
SQKARRLLKGSGFHLDLLLIGSLGGLCGLFGLPWLTAATVRSVTHVNALTVMRTAIAPGDKP
QIQEVREQRVTGVLIASLVGLSIVMGAVLRRIPLAVLFGIFLYMGVTSLSGIQLSQRLLLILMP
AKHHPEQPYVTKVKTWRMHLFTCIQLGCIALLWVVKSTAASLAFPFLLLLTVPLRHCLLPRL
FQDRELQALDSEDAEPNFDEDGQDEYNELHMPV
(SEQ ID NO: 1281)

>gi|157694513|ref|NP_060960.2|leucine-rich repeat-containing G-protein coupled receptor 4
precursor {Homo sapiens}
MPGPLGLLCFLALGLLGSAGPSGAAPPLCAAPCSCDGDRRVDCSGKGLTAVPEGLSAFTQAL
DISMNNITQLPEDAFKNFPFLEELQLAGNDLSFIHPKALSGLKELKVLTLQNNQLKTVPSEAIR
GLSALQSLRLDANHITSVPEDSFEGLVQLRHLWLDDNSLTEVPVHPLSNLPTLQALTLALNKI
SSIPDFAFTNLSSLVVLHLHNNKIRSLSQHCFDGLDNLETLDLNYNNLGEFFPQAIKALPSLKEL
GFHSNSISVIPDGAFDGNPLLRTIHLYDNPLSFVGNSAFHNLSDLHSLVIRGASMVQQFPNLTG
TVHLESLTLTGTKISSIPNNLCQEQKMLRTLDLSYNNIRDLPSFNGCHALEEISLQRNQIYQIKE
GTFQGLISLRILDLSRNLIHEIHSRAFATLGPITNLDVSFNELTSFPTEGLNLQLKLVGNFKL
KEALAAKDFVNLRSLSVPYAYQCCAFWGCDSYANLNTEDNSLQDHSVAQEKGTADAANVT
STLENEEHSQIIIHCTPSTGAFKPCEYLLGSWMIRLTVWFIFLVALFFNLLVILTTFASCTSLPSS
KLFIGLISVSNLFMGIYTGILTFLDAVSWGRFAEFGIWWETGSGCKVAGFLAVFSSESAIFLLM
LATVERSLSAKDIMKNGKSNHLKQFRVAALLAFLGATVAGCFPLFHRGEYSASPLCLPFPTG
ETPSLGFTVTLVLLNSLAFLLMAVIYTKLYCNLEKEDLSENSQSSMIKHVAWLIFTNCIFFCPV
AFFSFAPLITAISISPEIMKSVTLIFFPLPACLNPVLYVFFNPKFKEDWKLLKRRVTKKSGSVSVS
ISSQGGCLEQDFYYDCGMYSHLQGNLTVCDCCESFLLTKPVSCKHLIKSHSCPALAVASCQR
PEGYWSDCGTQSAHSDYADEEDSFVSDSSDQVQACGRACFYQSRGFPLVRYAYNLPRVKD
(SEQ ID NO: 1282)

>gi|157738685|ref|NP_937822.2|G protein-coupled receptor 103 {Homo sapiens}
MQALNITPEQFSRLLRDHNLTREQFIALYRLRPLVYTPELPGRAKLALVLTGVLIFALALFGN
ALVFYVVTRSKAMRTVTNIFICSLALSDLLITFFCIPVTMLQNISDNWLGGAFICKMVPFVQST
AVVTEILTMTCIAVERHQGLVHPFKMKWQYTNRRAFTMLGVVWLVAVIVGSPMWHVQQL
EIKYDFLYEKEHICCLEEWTSPVHQKIYTTFILVILFLLPLMVMLILYSKIGYELWIKKRVGDG
SVLRTIHGKEMSKIARKKKRAVIMMVTVVALFAVCWAPFHVVHMMIEYSNFEKEYDDVTIK TABLE 4-continued Targets from which the Analogs are derived MIFAIVQIIGFSNSICNPIVYAFMNENFKKNVLSAVCYCIVNKTFSPAQRHGNSGITMMRKKA
KFSLRENPVEETKGEAFSDGNIEVKLCEQTEEKKKLKRHLALFRSELAENSPLDSGH
(SEQ ID NO: 1283)

>gi|157738694|ref|NP_006009.2|G-protein coupled receptor 109B {Homo sapiens}
MNRHHLQDHFLEIDKKNCCVFRDDFIAKVLPPVLGLEFIFGLLGNGLALWIFCFHLKSWKSSR
IFLFNLAVADFLLIICLPFVMDYYVRRSDWKFGDIPCRLVLFMFAMNRQGSIIFLTVVAVDRY
FRVVHPHHALNKISNWTAAIISCLLWGITVGLTVHLLKKKLLIQNGTANVCISFSICHTFRWH
EAMFLLEFFLPLGIILFCSARIIWSLRQRQMDRHAKIKRAITFIMVVAIVFVICFLPSVVVRIHIF
WLLHISGTQNCEVYRSVDLAFFITLSFTYMNSMLDPVVYYFSSPSFPNFFSTLINRCLQRKITG
EPDNNRSTSVELTGDPNKTRGAPEALIANSGEPWSPSYLGPTSNNHSKKGHCHQEPASLEKQ
LGCCIE
(SEQ ID NO: 1284)

>gi|161484640|ref|NP_002502.2|neuromedin-B receptor {Homo sapiens}
MPSKSLSNLSVTTGANESGSVPEGWERDFLPASDGTTTELVIRCVIPSLYLLIITVGLLGNIML
VKIFITNSAMRSVPNIFISNLAAGDLLLLLTCVPVDASRYFFDEWMFGKVGCKLIPVIQLTSVG
VSVFTLTALSADRYRAIVNPMDMQTSGALLRTCVKAMGIWVVSVLLAVPEAVFSEVARISSL
DNSSETACIPYPQTDELHPKIHSVLIFLVYFLIPLAIISIYYYHIAKTLIKSAHNLPGEYNEHTKK
QMETRKRLAKIVLVFVGCFIFCWFPNHILYMYRSFNYNEIDPSLGHMIVTLVARVLSFGNSCV
NPFALYLLSESFRRHFNSQLCCGRKSYQERGTSYLLSSSAVRMTSLKSNAKNMVTNSVLLNG
HSMKQEMAL
(SEQ ID NO: 1285)

>gi|163792198|ref|NP_056051.2|latrophilin-3 precursor {Homo sapiens}
MWPSQLLIFMMLLAPIIHAFSRAPIPMAVVRRELSCESYPIELRCPGTDVIMIESANYGRTDDK
ICDSDPAQMENIRCYLPDAYKIMSQRCNNRTQCAVVAGPDVFPDPCPGTYKYLEVQYECVP
YKVEQKVFLCPGLLKGVYQSEHLFESDHQSGAWCKDPLQASDKIYYMPWTPYRTDTLTEYS
SKDDFIAGRPTTTYKLPHRVDGTGFVVYDGALFFNKERTRNIVKFDLRTRIKSGEAITANANY
HDTSPYRWGGKSDIDLAVDENGLWVIYATEQNNGKIVISQLNPYTLRIEGTWDTAYDKRSAS
NAFMICGILYVVKSVYEDDDNEATGNKIDYIYNTDQSKDSLVDVPFPNSYQYIAAVDYNPRD
NLLYVMNNYHVVKYSLDFGPLDSRSGQAHHGQVSYISPPIHLDSELERPSVKDISTTGPLGM
GSTTTSTTLRTTTLSPGRSTTPSVSGRRNRSTSTPSPAVEVLDDMTTHLPSASSQIPALEESCEA
VEAREIMWFKTRQGQIAKQPCPAGTIGVSTYLCLAPDGIWDPQGPDLSNCSSPWVNHITQKL
KSGETAANIARELAEQTRNHLNAGDITYSVRAMDQLVGLLDVQLRNLTPGGKDSAARSLNK
LQKRERSCRAYVQAMVETVNNLLQPQALNAWRDLTTSDQLRAATMLLHTVEESAFVLADN
LLKTDIVRENTDNIKLEVARLSTEGNLEDLKEPENMGHGSTIQLSANTLKQNGRNGEIRVAFV
LYNNLGPYLSTENASMKLGTEALSTNHSVIVNSPVITAAINKEFSNKVYLADPVVFTVKHIKQ
SEENFNPNCSFWSYSKRTMTGYWSTQGCRLLTTNKTHTTCSCNHLTNFAVLMAHVEVKHSD
AVHDLLLDVITWVGILLSLVCLLICIFTFCFFRGLQSDRNTIHKNLCISLFVAELLFLIGINRTDQ
PIACAVFAALLHFFFLAAFTWMFLEGVQLYIMLVEVFESEHSRRKYFYLVGYGMPALIVAVS
AAVDYRSYGTDKVCWLRLDTYFIWSFIGPATLIIMLNVIFLGIALYKMFHHTAILKPESGCLD
NINYEDNRPFIKSWVIGAIALLCLLGLTWAFGLMYINESTVIMAYLFTIENSLQGMFIFIFHCVL
QKKVRKEYGKCLRTHCCSGKSTESSIGSGKTSGSRTPGRYSTGSQSRIRRMWNDTVRKQSES
SFITGDINSSASLNREGLLNNARDTSVMDTLPLNGNHGNSYSIASGEYLSNCVQIIDRGYNHN
ETALEKKILKELTSNYIPSYLNNHERSSEQNRNLMNKLVNNLGSGREDDAIVLDDATSFNHEE
SLGLELIHEESDAPLLPPRVYSTENHQPHHYTRRRIPQDHSESFFPLLTNEHTEDLQSPHRDSL
YTSMPTLAGVAATESVTTSTQTEPPPAKCGDAEDVYYKSMPNLGSRNHVHQLHTYYQLGRG
SSDGFIVPPNKDGTPPEGSSKGPAHLVTSL
(SEQ ID NO: 1286)

>gi|166362740|ref|NP_001983.2|proteinase-activated receptor 1 precursor {Homo sapiens}
MGPRRLLLVAACFSLCGPLLSARTRARRPESKATNATLDPRSFLLRNPNDKYEPFWEDEEKN
ESGLTEYRLVSINKSSPLQKQLPAFISEDASGYLTSSWLTLFVPSVYTGVFVVSLPLNIMAIVVF
ILKMKVKKPAVVYMLHLATADVLFVSVLPFKISYYFSGSDWQFGSELCRFVTAAFYCNMYA
SILLMTVISIDRFLAVVYPMQSLSWRTLGRASFTCLAIWALAIAGVVPLLLKEQTIQVPGLNIT
TCHDVLNETLLEGYYAYYFSAFSAVFFFVPLIISTVCYVSIIRCLSSSAVANRSKKSRALFLSAA
VFCIFIICFGPTNVLLIAHYSFLSHTSTTEAAYFAYLLCVCVSSISCCIDPLIYYASSECQRYVY
SILCCKESSDPSSYNSSGQLMASKMDTCSSNLNNSIYKKLLT
(SEQ ID NO: 1287)

>gi|166795283|ref|NP_002053.3|glucagon-like peptide 1 receptor precursor {Homo sapiens}
MAGAPGPLRLALLLLGMVGRAGPRPQGATVSLWETVQKWREYRRQCQRSLTEDPPPATDLF
CNRTFDEYACWPDGEPGSFVNVSCPWYLPWASSVPQGHVYRFCTAEGLWLQKDNSSLPWR
DLSECEESKRGERSSPEEQLLFLYIIYTVGYALSFSALVIASAILLGFRHLHCTRNYIHLNLFASF
ILRALSVFIKDAALKWMYSTAAQQHQWDGLLSYQDSLSCRLVFLLMQYCVAANYYWLLVE
GVYLYTLLAFSVLSEQWIFRLYVSIGWGVPLLFVVPWGIVKYLYEDEGCWTRNSNMNYWLII
RLPILFAIGVNFLIFVRVICIVVSSKLKANLMCKTDIKCRLAKSTLTLIPLLGTHEVIFAFVMDEH
ARGTLRFTKLFTELSFTSFQGLMVAILYCFVNNEVQLEFRKSWERWRLEHLHIQRDSSMKPLK
CPTSSLSSGATAGSSMYTATCQASCS
(SEQ ID NO: 1288)

>gi|166999098|ref|NP_000829.2|metabotropic glutamate receptor 1 isoform alpha precursor {Homo sapiens}
MVGLLLFFFPAIFLEVSLLPRSPGRKVLLAGASSQRSVARMDGDVIIGALFSVHHQPPAEKVP
ERKCGEIREQYGIQRVEAMFHTLDKINADPVLLPNITLGSEIRDSCWHSSVALEQSIEFIRDSLI
SIRDEKDGINRCLPDGQSLPPGRTKKPIAGVIGPGSSSVAIQVQNLLQLFDIPQIAYSATSIDLSD
KTLYKYFLRVVPSDTLQARAMLDIVKRYNWTYVSAVHTEGNYGESGMDAFKELAAQEGLC

TABLE 4-continued

Targets from which the Analogs are derived

```
IAHSDKIYSNAGEKSFDRLLRKLRERLPKARVVVCFCEGMTVRGLLSAMRRLGVVGEFSLIG
SDGWADRDEVIEGYEVEANGGITIKLQSPEVRSFDDYFLKLRLDTNTRNPWFPEFWQHRFQC
RLPGHLLENPNFKRICTGNESLEENYVQDSKMGFVINAIYAMAHGLQNMHHALCPGHVGLC
DAMKPIDGSKLLDFLIKSSFIGVSGEEVWFDEKGDAPGRYDIMNLQYTEANRYDYVHVGTW
HEGVLNIDDYKIQMNKSGVVRSVCSEPCLKGQIKVIRKGEVSCCWICTACKENEYVQDEFTC
KACDLGWWPNADLTGCEPIPVRYLEWSNIESIIAIAFSCLGILVTLFVTLIFVLYRDTPVVKSSS
RELCYIILAGIFLGYVCPFTLIAKPTTTSCYLQRLLVGLSSAMCYSALVTKTNRIARILAGSKKK
ICTRKPRFMSAWAQVIIASILISVQLTLVVTLIIMEPPMPILSYPSIKEVYLICNTSNLGVVAPLG
YNGLLIMSCTYYAFKTRNVPANFNEAKYIAFTMYTTCIIWLAFVPIYFGSNYKIITTCFAVSLS
VTVALGCMFTPKMYIIIAKPERNVRSAFTTSDVVRMHVGDGKLPCRSNTFLNIFRRKKAGAG
NANSNGKSVSWSEPGGGQVPKGQHMWHRLSVHVKTNETACNQTAVIKPLTKSYQGSGKSL
TFSDTSTKTLYNVEEEEDAQPIRFSPPGSPSMVVHRRVPSAATTPPLPSHLTAEETPLFLAEPAL
PKGLPPPLQQQQQPPPQQKSLMDQLQGVVSNFSTAIPDFHAVLAGPGGPGNGLRSLYPPPPPP
QHLQMLPLQLSTFGEELVSPPADDDDDSERFKLLQEYVYEHEREGNTEEDELEEEEEDLQAA
SKLTPDDSPALTPPSPFRDSVASGSSVPSSPVSESVLCTPPNVSYASVILRDYKQSSSTL
(SEQ ID NO: 1289)

>gi|167000885|ref|NP_001471.2|galanin receptor type 1 {Homo sapiens}
MELAVGNLSEGNASWPEPPAPEPGPLFGIGVENFVTLVVFGLIFALGVLGNSLVITVLARSKP
GKPRSTTNLFILNLSIADLAYLLFCIPFQATVYALPTWVLGAFICKFIHYFFTVSMLVSIFTLAA
MSVDRYVAIVHSRRSSSLRVSRNALLGVGCIWALSIAMASPVAYHQGLFHPRASNQTFCWE
QWPDPRHKKAYVVCTFVFGYLLPLLLICFCYAKVLNHLHKKLKNMSKKSEASKKKTAQTVL
VVVVVFGISWLPHHIIHLWAEFGVFPLTPASFLFRITAHCLAYSNSSVNPIIYAFLSENFRKAYK
QVFKCHIRKDSHLSDTKESKSRIDTPPSTNCTHV
(SEQ ID NO: 1290)

>gi|170671732|ref|NP_063941.3|melanocortin receptor 3 {Homo sapiens}
MNASCCLPSVQPTLPNGSEHLQAPFFSNQSSSAFCEQVFIKPEVFLSLGIVSLLENILVILAVVR
NGNLHSPMYFFLCSLAVADMLVSVSNALETIMIAIVHSDYLTFEDQFIQHMDNIFDSMICISLV
ASICNLLAIAVDRYVTIFYALRYHSIMTVRKALTLIVAIWVCCGVCGVVFIVYSESKMVIVCLI
TMFFAMMLLMGTLYVHMFLFARLHVKRIAALPPADGVAPQQHSCMKGAVTITILLGVFIFC
WAPFFLHLVLIITCPTNPYCICYTAHFNTYLVLIMCNSVIDPLIYAFRSLELRNTFREILCGCNG
MNLG
(SEQ ID NO: 1291)

>gi|170932505|ref|NP_064552.3|neuromedin-U receptor 2 {Homo sapiens}
MSGMEKLQNASWIYQQKLEDPFQKHLNSTEEYLAFLCGPRRSHFFLPVSVVYVPIFVVGVIG
NVLVCLVILQHQAMKTPTNYYLFSLAVSDLLVLLLGMPLEVYEMWRNYPFLGPVGCYFKT
ALFETVCFASILSITTVSVERYVAILHPFRAKLQSTRRRALRILGIVWGFSVLFSLPNTSIFIGIKF
HYFPNGSLVPGSATCTVIKPMWIYNFIIQVTSFLFYLLPMTVISVLYYLMALRLKKDKSLEAD
EGNANIQRPCRKSVNKMLFVLVLVFAICWAPFHIDRLFFSFVEEWSESLAAVFNLVHVVSGV
FFYLSSAVNPIIYNLLSRRFQAAFQNVISSFHKQWHSQHDPQLPPAQRNIFLTECHFVELTEDIG
PQFPCQSSMHNSHLPAALSSEQMSRTNYQSFHFNKT
(SEQ ID NO: 1292)

>gi|183979980|ref|NP_001116513.2|C-C chemokine receptor type 2 isoform A {Homo sapiens}
MLSTSRSRFIRNTNESGEEVTTFFDYDYGAPCHKFDVKQIGAQLLPPLYSLVFIFGFVGNMLV
VLILINCKKLKCLTDIYLLNLAISDLLFLITLPLWAHSAANEWVFGNAMCKLFTGLYHIGYFG
GIFFIILLTIDRYLAIVHAVFALKARTVTFGVVTSVITWLVAVFASVPGIIFTKCQKEDSVYVCG
PYFPRGWNNFHTIMRNILGLVLPLLIMVICYSGILKTLLRCRNEKKRHRAVRVIFTIMIVYPLF
WTPYNIVILLNTFQEFFGLSNCESTSQLDQATQVTETLGMTHCCINPIIYAFVGEKFRSLFHIAL
GCRIAPLQKPVCGGPGVRPGKNVKVTTQGLLDGRGKGKSIGRAPEASLQDKEGA
(SEQ ID NO: 1293)

>gi|183979982|ref|NP_001116868.1|C-C chemokine receptor type 2 isoform B {Homo sapiens}
MLSTSRSRFIRNTNESGEEVTTFFDYDYGAPCHKFDVKQIGAQLLPPLYSLVFIFGFVGNMLV
VLILINCKKLKCLTDIYLLNLAISDLLFLITLPLWAHSAANEWVFGNAMCKLFTGLYHIGYFG
GIFFIILLTIDRYLAIVHAVFALKARTVTFGVVTSVITWLVAVFASVPGIIFTKCQKEDSVYVCG
PYFPRGWNNFHTIMRNILGLVLPLLIMVICYSGILKTLLRCRNEKKRHRAVRVIFTIMIVYPLF
WTPYNIVILLNTFQEFFGLSNCESTSQLDQATQVTETLGMTHCCINPIIYAFVGEKFRRYLSVF
FRKHITKRFCKQCPVFYRETVDGVTSTNTPSTGEQEVSAGL
(SEQ ID NO: 1294)

>gi|187960055|ref|NP_005675.3|probable G-protein coupled receptor 52 {Homo sapiens}
MNESRWTEWRILNMSSGIVNVSERHSCPLGFGHYSVVDVCIFETVVIVLLTFLIIAGNLVIFV
FHCAPLLHHYTTSYFIQTMAYADLFVGVSCLVPTLSLLHYSTGVHESLTCQVFGYIISVLKSVS
MACLACISVDRYLAITKPLSYNQLVTPCRLRICIILIWIYSCLIFLPSFFGWGKPGYHGDIFEWC
ATSWLTSAYFTGFIVCLLYAPAAFVVCFTYFHIFKICRQHTKEINDRRARFPSHEVDSSRETGH
SPDRRYAMVLFRITSVPYMLWLPYIIYFLLESSRVLDNPTLSFLTTWLAISNSFCNCVIYSLSNS
VFRLGLRRLSETMCTSCMCVKDQEAQEPKPRKRANSCSI
(SEQ ID NO: 1295)

>gi|187960067|ref|NP_000836.2|metabotropic glutamate receptor 8 isoform a precursor {Homo
sapiens}
MVCEGKRSASCPCFFLLTAKFYWILTMMQRTHSQEYAHSIRVDGDIILGGLFPVHAKGERGV
PCGELKKEKGIHRLEAMLYAIDQINKDPDLLSNITLGVRILDTCSRDTYALEQSLTFVQALIEK
DASDVKCANGDPPIFTKPDKISGVIGAAASSVSIMVANILRLFKIPQISYASTAPELSDNTRYDF
FSRVVPPDSYQAQAMVDIVTALGWNYVSTLASEGNYGESGVEAFTQISREIGGVCIAQSQKIP
```

TABLE 4-continued

Targets from which the Analogs are derived

REPRPGEFEKIIKRLLETPNARAVIMFANEDDIRRILEAAKKLNQSGHFLWIGSDSWGSKIAPV
YQQEEIAEGAVTILPKRASIDGFDRYFRSRTLANNRRNVWFAEFWEENFGCKLGSHGKRNSH
IKKCTGLERIARDSSYEQEGKVQFVIDAVYSMAYALHNMHKDLCPGYIGLCPRMSTIDGKEL
LGYIRAVNFNGSAGTPVTFNENGDAPGRYDIFQYQITNKSTEYKVIGHWTNQLHLKVEDMQ
WAHREHTHPASVCSLPCKPGERKKTVKGVPCCWHCERCEGYNYQVDELSCELCPLDQRPN
MNRTGCQLIPIIKLEWHSPWAVVPVFVAILGIIATTFVIVTFVRYNDTPIVRASGRELSVVLLTG
IFLCYSITFLMIAAPDTIICSFRRVFLGLGMCFSYAALLTKTNRIHRIFEQGKKSVTAPKFISPAS
QLVITFSLISVQLLGVFVWFVVDPPHIIIDYGEQRTLDPEKARGVLKCDISDLSLICSLGYSILL
MVTCTVYAIKTRGVPETFNEAKPIGFTMYTTCIIWLAFIPIPFFGTAQSAEKMYIQTTTLTVSMS
LSASVSLGMLYMPKVYIIIFHPEQNVQKRKRSFKAVVTAATMQSKLIQKGNDRPNGEVKSEL
CESLETNTSSTKTTYISYSNHSI
(SEQ ID NO: 1296)

>gi|188497623|ref|NP_006047.3|neuromedin-U receptor 1 {Homo sapiens}
MTPLCLNCSVLPGDLYPGGARNPMACNGSAARGHFDPEDLNLTDEALRLKYLGPQQTELFM
PICATYLLIFVVGAVGNGLTCLVILRHKAMRTPTNYYLFSLAVSDLLVLLVGLPLELYEMWH
NYPFLLGVGGCYFRTLLFEMVCLASVLNVTALSVERYVAVVHPLQARSMVTRAHVRRVLG
AVWGLAMLCSLPNTSLHGIRQLHVPCRGPVPDSAVCMLVRPRALYNMVVQTTALLFFCLPM
AIMSVLYLLIGLRLRRERLLLMQEAKGRGSAAARSRYTCRLQQHDRGRRQVTKMLFVLVVV
FGICWAPFHADRVMWSVVSQWTDGLHLAFQHVHVISGIFFYLGSAANPVLYSLMSSRFRETF
QEALCLGACCHRLRPRHSSHSLSRMTTGSTLCDVGSLGSWVHPLAGNDGPEAQQETDPS
(SEQ ID NO: 1297)

>gi|193083134|ref|NP_002377.4|melanocyte-stimulating hormone receptor {Homo sapiens}
MAVQGSQRRLLGSLNSTPTAIPQLGLAANQTGARCLEVSISDGLFLSLGLVSLVENALVVATI
AKNRNLHSPMYCFICCLALSDLLVSGSNVLETAVILLLEAGALVARAAVLQQLDNVIDVITCS
SMLSSLCFLGAIAVDRYISIFYALRYHSIVTLPRARRAVAAIWVASVVFSTLFIAYYDHVAVLL
CLVVFFLAMLVLMAVLYVHMLARACQHAQGIARLHKRQRPVHQGFGLKGAVTLTILLGIFF
LCWGPFFLHLTLIVLCPEHPTCGCIFKNFNLFLALIICNAIIDPLIYAFHSQELRRTLKEVLTCSW
(SEQ ID NO: 1298)

>gi|194018562|ref|NP_009163.2|histamine receptor H3 {Homo sapiens}
MERAPPDGPLNASGALAGEAAAAGGARGFSAAWTAVLAALMALLIVATVLGNALVMLAFV
ADSSLRTQNNFFLLNLAISDFLVGAFCIPLYVPYVLTGRWTFGRGLCKLWLVVDYLLCTSSAF
NIVLISYDRFLSVTRAVSYRAQQGDTRRAVRKMLLVWVLAFLLYGPAILSWEYLSGGSSIPEG
HCYAEFFYNWYFLITASTLEFFTPFLSVTFFNLSIYLNIQRRTRLRLDGAREAAGPEPPPEAQPS
PPPPPGCWGCWQKGHGEAMPLHRYGVGEAAVGAEAGEATLGGGGGGGSVASPTSSSGSSS
RGTERPRSLKRGSKPSASSASLEKRMKMVSQSFTQRFRLSRDRKVAKSLAVIVSIFGLCWAPY
TLLMIIRAACHGHCVPDYWYETSFWLLWANSAVNPVLYPLCHHSFRRAFTKLLCPQKLKIQP
HSSLEHCWK
(SEQ ID NO: 1299)

>gi|194272183|ref|NP_116166.7|probable G-protein coupled receptor 124 precursor {Homo sapiens}
MGAGGRRMRGAPARLLLPLLPWLLLLLAPEARGAPGCPLSIRSCKCSGERPKGLSGGVPGPA
RRRVVCSGGDLPEPPEPGLLPNGTVTLLLSNNKITGLRNGSFLGLSLLEKLDLRNNIISTVQPG
AFLGLGELKRLDLSNNRIGCLTSETFQGLPRLRLNISGNIFSSLQPGVFDELPALKVVDLGTE
FLTCDCHLRWLLPWAQNRSLQLSEHTLCAYPSALHAQALGSLQEAQLCCEGALELHTHHLIP
SLRQVVFQGDRLPFQCSASYLGNDTRIRWYHNRAPVEGDEQAGILLAESLIHDCTFITSELTLS
HIGVWASGEWECTVSMAQGNASKKVEIVVLETSASYCPAERVANNRGDFRWPRTLAGITAY
QSCLQYPFTSVPLGGGAPGTRASRRCDRAGRWEPGDYSHCLYTNDITRVLYTFVLMPINASN
ALTLAHQLRVYTAEAASFSDMMDVYVAQMIQKFLGYVDQIKELVEVMVDMASNLMLVD
EHLLWLAQREDKACSRIVGALERIGGAALSPHAQHISVNARNVALEAYLIKPHSYVGLTCTA
FQRREGGVPGTRPGSPGQNPPPEPEPPADQQLRFRCTTGRPNVSLSSFHIKNSVALASIQLPPSL
FSSLPAALAPPVPPDCTLQLLVFRNGRLFHSHSNTSRPGAAGPGKRRGVATPVIFAGTSGCGV
GNLTEPVAVSLRHWAEGAEPVAAWWSQEGPGEAGGWTSEGCQLRSSQPNVSALHCQHLGN
VAVLMELSAFPREVGGAGAGLHPVVYPCTALLLLCLFATIITYILNHSSIRVSRKGWHMLLNL
CFHIAMTSAVFAGGITLTNYQMVCQAVGITLHYSSLSTLLWMGVKARVLHKELTWRAPPPQ
EGDPALPTPSPMLRFYLIAGGIPLIICGITAAVNIHNYRDHSPYCWLVWRPSLGAFYIPVALILL
ITWIYFLCAGLRLRGPLAQNPICAGNSRASLEAGEELRGSTRLRGSGPLLSDSGSLLATGSARV
GTPGPPEDGDSLYSPGVQLGALVTTHFLYLAMWACGALAVSQRWLPRVVCSCLYGVAASA
LGLFVFTHHCARRRDVRASWRACCPPASPAAPHAPPRALPAAAEDGSPVFGEGPPSLKSSPSG
SSGHPLALGPCKLTNLQLAQSQVCEAGAAAGGEGEPEPAGTRGNLAHRHPNNVHHGRRAH
KSRAKGHRAGEACGKNRLKALRGGAAGALELLSSESGSLHNSPTDSYLGSSRNSPGAGLQLE
GEPMLTPSEGSDTSAAPLSEAGRAGQRRSASRDSLKGGGALEKESHRRSYPLNAASLNGAPK
GGKYDDVTLMGAEVASGGCMKTGLWKSETTV
(SEQ ID NO: 1300)

>gi|194294562|ref|NP_795713.2|P2Y purinoceptor 13 {Homo sapiens}
MTAAIRRQRELSILPKVTLEAMNTTVMQGFNRSERCPRDTRIVQLVFPALYTVVFLTGILLNT
LALWVHIPSSSTFIIYLKNTLVADLIMTLMLPFKILSDSHLAPWQLRAFVCRFSSVIFYETM
YVGIVLLGLIAFDRFLKIIRPLRNIFLKKPVFAKTVSIFIWFFLFFISLPNTILSNKEATPSSVKKC
ASLKGPLGLKWHQMVNNICQFIFWTVFILMLVFYVVIAKKVYDSYRKSKSKDRKNNKKLEG
KVFVVVAVFFVCFAPPHFARVPYTHSQTNNKTDCRLQNQLFIAKETTLFLAATNICMDPLIYI
FLCKKFTEKLPCMQGRKTTASSQENHSSQTDN
ITLG
(SEQ ID NO: 1301)

TABLE 4-continued

Targets from which the Analogs are derived

>gi|194353970|ref|NP_000672.3|alpha-2A adrenergic receptor {Homo sapiens}
MFRQEQPLAEGSFAPMGSLQPDAGNASWNGTEAPGGGARATPYSLQVTLTLVCLAGLLMLL
TVFGNVLVIIAVFTSRALKAPQNLFLVSLASADILVATLVIPFSLANEVMGYWYFGKAWCEIY
LALDVLFCTSSIVHLCAISLDRYWSITQAIEYNLKRTPRRIKAIIITVWVISAVISFPPLISIEKKG
GGGGPQPAEPRCEINDQKWYVISSCIGSFFAPCLIMILVYVRIYQIAKRRTRVPPSRRGPDAVA
APPGGTERRPNGLGPERSAGPGGAEAEPLPTQLNGAPGEPAPAGPRDTDALDLEESSSSDHAE
RPPGPRRPERGPRGKGKARASQVKPGDSLPRRGPGATGIGTPAAGPGEERVGAAKASRWRG
RQNREKRFTFVLAVVIGVFVVCWFPFFFTYTLTAVGCSVPRTLFKFFFWFGYCNSSLNPVIVTI
FNHDFRRAFKKILCRGDRKRIV
(SEQ ID NO: 1302)

>gi|222080049|ref|NP_000858.3|5-hydroxytryptamine receptor 2B {Homo sapiens}
MALSYRVSELQSTIPEHILQSTFVHVISSNWSGLQTESIPEEMKQIVEEQGNKLHWAALLILMV
IIPTIGGNTLVILAVSLEKKLQYATNYFLMSLAVADLLVGLFVMPIALLTIMFEAMWPLPLVL
CPAWLFLDVLFSTASIMHLCAISVDRYIAIKKPIQANQYNSRATAFIKITVVWLISIGIAIPVPIK
GIETDVDNPNNITCVLTKERFGDFMLFGSLAAFFTPLAIMIVTYFLTIHALQKKAYLVKNKPP
QRLTWLTVSTVFQRDETPCSSPEKVAMLDGSRKDKALPNSGDETLMRRTSTIGKKSVQTISN
EQRASKVLGIVFFLFLLMWCPFFITNITLVLCDSCNQTTLQMLLEIFVWIGYVSSGVNPLVYTL
FNKTFRDAFGRYITCNYRATKSVKTLRKRSSKIYFRNPMAENSKFFKKHGIRNGINPAMYQSP
MRLRSSTIQSSSIILLDTLLLTENEGDKTEEQVSYV
(SEQ ID NO: 1303)

>gi|222080095|ref|NP_001516.2|orexin receptor type 1 {Homo sapiens}
MEPSATPGAQMGVPPGSREPSPVPPDYEDEFLRYLWRDYLYPKQYEWVLIAAYVAVFVVAL
VGNTLVCLAVWRNHHMRTVTNYFIVNLSLADVLVTAICLPASLLVDITESWLFGHALCKVIP
YLQAVSVSVAVLTLSFIALDRWYAICHPLLFKSTARRARGSILGIWAVSLAIMVPQAAVMECS
SVLPELANRTRLFSVCDERWADDLYPKIYHSCFFIVTYLAPLGLMAMAYFQIFRKLWGRQIP
GTTSALVRNWKRPSDQLGDLEQGLSGEPQPRARAFLAEVKQMRARRKTAKMLMVVLLVFA
LCYLPISVLNVLKRVFGMFRQASDREAVYACFTFSHWLVYANSAANPIIYNFLSGKFREQFK
AAFSCCLPGLGPCGSLKAPSPRSSASHKSLSLQSRCSISKISEHVVLTSVTTVLP
(SEQ ID NO: 1304)

>gi|222080109|ref|NP_001517.2|orexin receptor type 2 {Homo sapiens}
MSGTKLEDSPPCRNWSSASELNETQEPFLNPTDYDDEEFLRYLWREYLHPKEYEWVLIAGYII
VFVVALIGNVLVCVAVWKNHHMRTVTNYFIVNLSLADVLVTITCLPATLVVDITETWFFGQS
LCKVIPYLQTVSVSVSVLTLSCIALDRWYAICHPLMFKSTAKRARNSIVIIWIVSCIIMIPQAIV
MECSTVFPGLANKTTLFTVCDERWGGEIYPKMYHICFFLVTYMAPLCLMVLAYLQIFRKLW
CRQIPGTSSVVQRKWKPLQPVSQPRGPGQPTKSRMSAVAAEIKQIRARRKTARMLMIVLLVF
AICYLPISILNVLKRVFGMFAHTEDRETVYAWFTFSHWLVYANSAANPIIYNFLSGKFREEFK
AAFSCCCLGVHHRQEDRLTRGRTSTESRKSLTTQISNFDNISKLSEQVVLTSISTLPAANGAGP
LQNW
(SEQ ID NO: 1305)

>gi|223633971|ref|NP_057624.3|probable G-protein coupled receptor 83 precursor {Homo sapiens}
MVPHLLLLCLLPLVRATEPHEGRADEQSAEAALAVPNASHFFSWNNYTFSDWQNFVGRRRY
GAESQNPTVKALLIVAYSFIIVFSLFGNVLVCHVIFKNQRMHSATSLFIVNLAVADIMITLLNT
PFTLVPRFVNSTWIFGKGMCHVSRFAQYCSLHVSALTLTAIAVDRHQVNHPLKPRISITKGVI
YIAVIWTMATFFSLPHAICQKLFTFKYSEDIVRSLCLPDFPEPADLFWKYLDLATFILLYILPLLI
ISVAYARVAKKLWLCNMIGDVTTEQYFALRRKKKKTIKMLMLVVVLFALCWPPLNCYVLL
LSSSKVIRTNNALYFAFHWFAMSSTCYNPFIYCWLNENFRIELKALLSMCQRPPKPQEDRPPSP
VPSFRVAWTEKNDGQRAPLANNLLPTSQLQSGKTDLSSVEPIVTMS
(SEQ ID NO: 1306)

>gi|223633986|ref|NP_003958.2|trace amine-associated receptor 5 {Homo sapiens}
MRAVFIQGAEEHPAAFCYQVNGSCPRTVHTLGIQLVIYLACAAGMLIIVLGNVFVAFAVSYF
KALHTPTNFLLLSLALADMFLGLLVLPLSTIRSVESCWFFGDFLCRLHTYLDTLFCLTSIFHLC
FISIDRHCAICDPLLYPSKFTVRVALRYILAGWGVPAAYTSLFLYTDVVETRLSQWLEEMPCV
GSCQLLLNKFWGWLNFPLFFVPCLIMISLYVKIFVVATRQAQQITTLSKSLAGAAKHERKAA
KTLGIAVGIYLLCWLPFTIDTMVDSLLHFITPPLVFDIFIWFAYFNSACNPIIYVFSYQWFRKAL
KLTLSQKVFSPQTRTVDLYQE
(SEQ ID NO: 1307)

>gi|224586796|ref|NP_076404.3|G-protein coupled receptor 87 {Homo sapiens}
MGFNLTLAKLPNNELHGQESHNSGNRSDGPGKNTTLHNEFDTIVLPVLYLIIFVASILLNGLA
VWIFFHIRNKTSFIFYLKNIVVADLIMTLTFPFRIVHDAGFGPWYFKFILCRYTSVLFYANMYT
SIVFLGLISIDRYLKVVKPFGDSRMYSITFTKVLSVCVWVIMAVLSLPNIILTNGQPTEDNIHDC
SKLKSPLGVKWHTAVTYVNSCLFVAVLVILIGCYIAISRYIHKSSRQFISQSSRKRKHNQSIRV
VVAVFFTCFLPYHLCRIPFTFSHLDRLLDESAQKILYYCKEITLFLSACNVCLDPIIYFFMCRSF
SRRLFKKSNIRTRSESIRSLQSVRRSEVRIYYDYTDV
(SEQ ID NO: 1308)

>gi|229093087|ref|NP_740746.4|probable G-protein coupled receptor 97 precursor {Homo sapiens}
MATPRGLGALLLLLLLPTSGQEKPTEGPRNTCLGSNNMYDIFNLNDKALCFTKCRQSGSDSC
NVENLQRYWLNYEAHLMKEGLTQKVNTPFLKALVQNLSTNTAEDFYFSLEPSQVPRQVMK
DEDKPPDRVRLPKSLFRSLPGNRSVVRLAVTILDIGPGTLFKGPRLGLGDGSGVLNNRLVGLS
VGQMHVTKLAEPLEIVFSHQRPPPNMTLTCVFWDVTKGTTGDWSSEGCSTEVRPEGTVCCC
DHLTFFALLRPTLDQSTVHILTRISQAGCGVSMIFLAFTIILYAFLRLSRERFKSEDAPKIHVA TABLE 4-continued Targets from which the Analogs are derived LGGSLFLLNLAFLVNVGSGSKGSDAACWARGAVFHYFLLCAFTWMGLEAFHLYLLAVRVF
NTYFGHYFLKLSLVGWGLPALMVIGTGSANSYGLYTIRDRENRTSLELCWFREGTTMYALYI
TVHGYFLITFLFGMVVLALVVWKIFTLSRATAVKERGKNRKKVLTLLGLSSLVGVTWGLAIF
TPLGLSTVYIFALFNSLQGVFICCWFTILYLPSQSTTVSSSTARLDQAHSASQE
(SEQ ID NO: 1309)

>gi|238859647|ref|NP_116176.2|probable G-protein coupled receptor 128 precursor {Homo sapiens}
MASCRAWNLRVLVAVVCGLLTGIILGLGIWRIVIRIQRGKSTSSSSTPTEFCRNGGTWENGRCI
CTEEWKGLRCTIANFCENSTYMGFTFARIPVGRYGPSLQTCGKDTPNAGNPMAVRLCSLSLY
GEIELQKVTIGNCNENLETLEKQVKDVTAPLNNISSEVQILTSDANKLTAENITSATRVVGQIF
NTSRNASPEAKKVAIVTVSQLLDASEDAFQRVAATANDDALTTLIEQMETYSLSLGNQSVVE
PNIAIQSANFSSENAVGPSNVRFSVQKGASSSLVSSSTFIHTNVDGLNPDAQTELQVLLNMTK
NYTKTCGFVVYQNDKLFQSKTFTAKSDFSQKIISSKTDENEQDQSASVDMVFSPKYNQKEFQ
LYSYACVYWNLSAKDWDTYGCQKDKGTDGFLRCRCNHTTNFAVLMTFKKDYQYPKSLDIL
SNVGCALSVTGLALTVIFQIVTRKVRKTSVTWVLVNLCISMLIFNLLFVFGIENSNKNLQTSD
GDINNIDFDNNDIPRTDTINIPNPMCTAIAALLHYFLLVTFTWNALSAAQLYYLLIRTMKPLPR
HPILFISLIGWGVPAIVVAITVGVIYSQNGNNPQWELDYRQEKICWLAIPEPNGVIKSPLLWSFI
VPVTIILISNVVMFITISIKVLWKNNQNLTSTKKVSSMKKIVSTLSVAVVFGITWILAYLMLVN
DDSIRIVFSYIFCLFNTTQGLQIFILYTVRTKVFQSEASKVLMLLSSIGRRKSLPSVTRPRLRVK
MYNFLRSLPTLHERFRLLETSPSTEEITLSESDNAKESI
(SEQ ID NO: 1310)

>gi|239582753|ref|NP_473373.2|mas-related G-protein coupled receptor member X4 {Homo sapiens}
MDPTVPVFGTKLTPINGREETPCYNQTLSFTVLTCIISLVGLTGNAVVLWLLGYRMRRNAVSI
YILNLAAADFLFLSFQIIRLPLRLINISHLIRKILVSVMTFPYFTGLSMLSAISTERCLSVLWPIW
YRCRRPTHLSAVVCVLLWGLSLLFSMLEWRFCDFLFSGADSSWCETSDFIPVAWLIFLCVVL
CVSSLVLLVRILCGSRKMPLTRLYVTILLTVLVFLLCGLPFGILGALIYRMHLNLEVLYCHVYL
VCMSLSSLNSSANPIIYFFVGSFRQRQNRQNLKLVLQRALQDKPEVDKGEGQLPEESLELSGS
RLGP
(SEQ ID NO: 1311)

>gi|256418985|ref|NP_001157849.1|MAS-related GPR, member G {Homo sapiens}
MFGLFGLWRTFDSVVFYLTLIVGLGGPVGNGLVLWNLGFRIKKGPFSIYLLHLAAADFLFLSC
RVGFSVAQAALGAQDTLYFVLTFLWFAVGLWLLAAFSVERCLSDLFPACYQGCRPRHASAV
LCALVWTPTLPAVPLPANACGLLRNSACPLVCPRYHVASVTWFLVLARVAWTAGVVLFVW
VTCCSTRPRPRLYGIVLGALLLLFFCGLPSVFYWSLQPLLNFLLPVFSPLATLLACVNSSSKPLI
YSGLGRQPGKREPLRSVLRRALGEGAELGARGQSLPMGLL
(SEQ ID NO: 1312)

>gi|260763892|ref|NP_473372.3|mas-related G-protein coupled receptor member X3 {Homo sapiens}
MDSTIPVLGTELTPINGREETPCYKQTLSFTGLTCIVSLVALTGNAVVLWLLGCRMRRNAVSI
YILNLVAADFLFLSGHIICSPLRLINIRHPISKILSPVMTFPYFIGLSMLSAISTERCLSILWPIWYH
CRRPRYLSSVMCVLLWALSLLRSILEWMFCDFLFSGANSVWCETSDFITIAWLVFLCVVLCG
SSLVLLVRILCGSRKMPLTRLYVTILLTVLVFLLCGLPFGIQWALFSRIHLDWKVLFCHVHLVS
IFLSALNSSANPIIYFFVGSFRQRQNRQNLKLVLQRALQDTPEVDEGGGWLPQETLELSGSRLEQ
(SEQ ID NO: 1313)

>gi|269973880|ref|NP_694547.2|probable G-protein coupled receptor 156 isoform 1 {Homo sapiens}
MEPEINCSELCDSFPGQELDRRPLHDLCKTTITSSHHSSKTISSLSPVLLGIVWTFLSCGLLLILF
FLAFTIHCRKNRIVKMSSPNLNIVTLLGSCLTYSSAYLFGIQDVLVGSSMETLIQTRLSMLCIGT
SLVFGPILGKSWRLYKVFTQRVPDKRVIIKDLQLLGLVAALLMADVILLMTWVLTDPIQCLQI
LSVSMTVTGKDVSCTSTSTHFCASRYSDVWIALIWGCKGLLLLYGAYLAGLTGHVSSPPVNQ
SLTIMVGVNLLVLAAGLLFVVTRYLHSWPNLVFGLTSGGIFVCTTTINCFIFIPQLKQWKAFEE
ENQTIRRMAKYFSTPNKSFHTQYGEEENCHPRGEKSSMERLLTEKNAVIESLQEQVNNAKEK
IVRLMSAECTYDLPEGAAPPASSPNKDVQAVASVHTLAAAQGPSGHLSDFQNDPGMAARDS
QCTSGPSSYAQSLEGPGKDSSFSPGKEEKISDSKDFSDHLDSGCSQKPWTEQSLGPERGDQVP
MNPSQSLLPERGGSDPQRQRHLENSEEPPERRSRVSSVIREKLQEVLQDLGLGPEASLSTAPSC
HQQTWKNSAAFSPQKMPLSKELGFSPYMVRRRRAAQRARSHFPPGSAPSSVGHRANRTVPGA
HSRLHVQNGDSPSLAPQTTDSRVRRPSSRKPSLPSDPQDRPGTLEGSKQSQTEPEGARGSKAA
FLRQPSGSGRAPSPAAPCLSKASPDLPEQWQLWPPVPSGCASLSSQHSYFDTESSSSDEFFCRC
HRPYCEICFQSSSDSSDSGTSDTDPEPTGGLASWEKLWARSKPIVNFKDDLKPTLV
(SEQ ID NO: 1314)

>gi|270265839|ref|NP_000264.2|G-protein coupled receptor 143 {Homo sapiens}
MASPRLGTFCCPTRDAATQLVLSFQPRAFHALCLGSGGLRLALGLLQLLPGRRPAGPGSPATS
PPASVRILRAAAACDLLGCLGMVIRSTVWLGFPNFVDSVSDMNHTEIWPAAFCVGSAMWIQ
LLYSACFWWLFCYAVDAYLVIRRSAGLSTILLYHIMAWGLATLLCVEGAAMLYYPSVSRCE
RGLDHAIPHYVTMYLPLLLVLVANPILFQKTVTAVASLLKGRQGIYTENERRMGAVIKIRFFK
IMLVLIICWLSNIINESLLFYLEMQTDINGGSLKPVRTAAKTTWFIMGILNPAQGFLLSLAFYG
WTGCSLGFQSPRKEIQWESLTTSAAEGAHPSPLMPHENPASGKVSQVGGQTSDEALSMLSEG
SDASTIEIHTASESCNKNEGDPALPTHGDL
(SEQ ID NO: 1315)

>gi|282403488|ref|NP_997253.2|probable G-protein coupled receptor 153 {Homo sapiens}
MSDERRLPGSAVGWLVCGGLSLLANAWGILSVGAKQKKWKPLEFLLCTLAATHMLNVAVP
IATYSVVQLRRQRPDFEWNEGLCKVFVSTFYTLTLATCFSVTSLSYHRMWMVCWPVNYRLS TABLE 4-continued Targets from which the Analogs are derived NAKKQAVHTVMGIWMVSFILSALPAVGWHDTSERFYTHGCRFIVAEIGLGFGVCFLLLVGGS
VAMGVICTAIALFQTLAVQVGRQADRRAFTVPTIVVEDAQGKRRSSIDGSEPAKTSLQTTGL
VTTIVFIYDCLMGFPVLVVSFSSLRADASAPWMALCVLWCSVAQALLLPVFLWACDRYRAD
LKAVREKCMALMANDEESDDETSLEGGISPDLVLERSLDYGYGGDFVALDRMAKYEISALE
GGLPQLYPLRPLQEDKMQYLQVPPTRRFSHDDADVWAAVPLPAFLPRWGSGEDLAALAHL
VLPAGPERRRASLLAFAEDAPPSRARRRSAESLLSLRPSALDSGPRGARDSPPGSPRRRPGPGP
RSASASLLPDAFALTAFECEPQALRRPPGPFPAAPAAPDGADPGEAPTPPSSAQRSPGPRPSAH
SHAGSLRPGLSASWGEPGGLRAAGGGGSTSSFLSSPSESSGYATLHSDSLGSAS
(SEQ ID NO: 1316)

>gi|284447291|ref|NP_997247.2|probable G-protein coupled receptor 148 {Homo sapiens}
MGDELAPCPVGTTAWPALIQLISKTPCMPQAASNTSLGLGDLRVPSSMLYWLFLPSSLLAAA
TLAVSPLLLVTILRNQRLRQEPHYLLPANILLSDLAYILLHMLISSSSLGGWELGRMACGILTD
AVFAACTSTILSFTAIVLHTYLAVIHPLRYLSFMSHGAAWKAVALIWLVACCFPTFLIWLSKW
QDAQLEEQGASYILPPSMGTQPGCGLLVIVTYTSILCVLFLCTALIANCFWRIYAEAKTSGIWG
QGYSRARGTLLIHSVLITLYVSTGVVFSLDMVLTRYHHIDSGTHTWLLAANSEVLMMLPRA
MLTYLYLLRYRQLLGMVRGHLPSRRQAIFTIS
(SEQ ID NO: 1317)

>gi|291042665|ref|NP_062813.2|leukotriene B4 receptor 2 {Homo sapiens}
MSVCYRPPGNETLLSWKTSRATGTAFLLLAALLGLPGNGFVVWSLAGWRPARGRPLAATLV
LHLALADGAVLLLTPLFVAFLTRQAWPLGQAGCKAVYYVCALSMYASVLLTGLLSLQRCLA
VTRPFLAPRLRSPALARRLLLAVWLAALLLAVPAAVYRHLWRDRVCQLCHPSPVHAAAHLS
LETLTAFVLPFGLMLGCYSVTLARLRGARWGSGRHGARVGRLVSAIVLAFGLLWAPYHAVN
LLQAVAALAPPEGALAKLGGAGQAARAGTTALAFFSSSVNPVLYVFTAGDLLPRAGPRFLTR
LFEGSGEARGGGRSREGTMELRTTPQLKVVGQGRGNGDPGGGMEKDGPEWDL
(SEQ ID NO: 1318)

>gi|4503825|ref|NP_003496.1|frizzled-1 precursor {Homo sapiens}
MAEEEAPKKSRAAGGGASWELCAGALSARLAEEGSGDAGGRRRPPVDPRRLARQLLLLLW
LLEAPLLLGVRAQAAGQGPGQGPGPGQQPPPPPQQQQSGQQYNGERGISVPDHGYCQPISIPL
CTDIAYNQTIMPNLLGHTNQEDAGLEVHQFYPLVKVQCSAELKFFLCSMYAPVCTVLEQALP
PCRSLCERARQGCEALMNKFGFQWPDTLKCEKFPVHGAGELCVGQNTSDKGTPTPSLLPEF
WTSNPQHGGGHRGGFPGGAGASERGKFSCPRALKVPSYLNYHFLGEKDCGAPCEPTKVYG
LMYFGPEELRFSRTWIGIWSVLCCASTLFTVLTYLVDMRRFSYPERPIIFLSGCYTAVAVAYIA
GFLLEDRVVCNDKFAEDGARTVAQGTKKEGCTILFMMLYFFSMASSIWWVILSLTWFLAAG
MKWGHEAIEANSQYFHLAAWAVPAIKTITILALGQVDGDVLSGVCFVGLNNVDALRGFVLA
PLFVYLFIGTSFLLAGFVSLFRIRTIMKHDGTKTEKLEKLMVRIGVFSVLYTVPATIVIACYFYE
QAFRDQWERSWVAQSCKSYAIPCPHLQAGGGAPPHPPMSPDFTVFMIKYLMTLIVGITSGFW
IWSGKTLNSWRKFYTRLTNSKQGETTV
(SEQ ID NO: 1319)

>gi|4503827|ref|NP_001457.1|frizzled-2 precursor {Homo sapiens}
MRPRSALPRLLLPLLLLPAAGPAQFHGEKGISIPDHGFCQPISIPLCTDIAYNQTIMPNLLGHTN
QEDAGLEVHQFYPLVKVQCSPELRFFLCSMYAPVCTVLEQAIPPCRSICERARQGCEALMNK
FGFQWPERLRCEHFPRHGAEQICVGQNHSEDGAPALLTTAPPPGLQPGAGGTPGGPGGGGAP
PRYATLEHPFHCPRVLKVPSYLSYKFLGERDCAAPCEPARPDGSMFFSQEETRFARLWILTWS
VLCCASTFFTVTTYLVDMQRFRYPERPIIFLSGCYTMVSVAYIAGFVLQERVVCNERFSEDGY
RTVVQGTKKEGCTILFMMLYFFSMASSIWWVILSLTWFLAAGMKWGHEAIEANSQYFHLAA
WAVPAVKTITILAMGQIDGDLLSGVCFVGLNSLDPLRGFVLAPLFVYLFIGTSFLLAGFVSLFR
IRTIMKHDGTKTEKLERLMVRIGVFSVLYTVPATIVIACYFYEQAFREHWERSWVSQHCKSL
AIPCPAHYTPRMSPDFTVYMIKYLMTLIVGITSGFWIWSGKTLHSWRKFYTRLTNSRHGETTV
(SEQ ID NO: 1320)

>gi|4503833|ref|NP_003498.1|frizzled-7 precursor {Homo sapiens}
MRDPGAAAPLSSLGLCALVLALLGALSAGAGAQPYHGEKGISVPDHGFCQPISIPLCTDIAYN
QTILPNLLGHTNQEDAGLEVHQFYPLVKVQCSPELRFFLCSMYAPVCTVLDQAIPPCRSLCER
ARQGCEALMNKFGFQWPERLRCENFPVHGAGEICVGQNTSDGSGPGGGPTAYPTAPYLPD
LPFTALPPGASDGRGRPAFPFSCPRQLKVPPYLGYRFLGERDCGAPCEPGRANGLMYFKEEER
RFARLWVGVWSVLCCASTLFTVLTYLVDMRRFSYPERPIIFLSGCYFMVAVAHVAGFLLEDR
AVCVERFSDDGYRTVAQGTKKEGCTILFMVLYFFGMASSIWWVILSLTWFLAAGMKWGHE
AIEANSQYFHLAAWAVPAVKTITILAMGQVDGDLLSGVCYVGLSSVDALRGFVLAPLFVYLF
IGTSFLLAGFVSLFRIRTIMKHDGTKTEKLEKLMVRIGVFSVLYTVPATIVLACYFYEQAFREH
WERTWLLQTCKSYAVPCPPGHFPPMSPDFTVFMIKYLMTMIVGITTGFWIWSGKTLQSWRRF
YHRLSHSSKGETAV
(SEQ ID NO: 1321)

>gi|4503835|ref|NP_003499.1|frizzled-9 precursor {Homo sapiens}
MAVAPLRGALLLWQLLAAGGAALEIGRFDPERGRGAAPCQAVEIPMCRGIGYNLTRMPNLL
GHTSQGEAAAELAEFAPLVQYGCHSHLRFFLCSLYAPMCTDQVSTPIPACRPMCEQARLRCA
PIMEQFNFGWPDSLDCARLPTRNDPHALCMEAPENATAGPAEPHKGLGMLPVAPRPARPPG
DLGPGAGGSGTCENPEKFQYVEKSRSCAPRCGPGVEVFWSRRDKDFALVWMAVWSALCFF
STAFTVLTFLLEPHRFQYPERPIIFLSMCYNVYSLAFLIRAVAGAQSVACDQEAGALYVIQEGL
ENTGCTLVFLLLYYFGMASSLWWVVLTLTWFLAAGKKWGHEAIEAHGSYFHMAAWGLPA
LKTIVILTLRKVAGDELTGLCYVASTDAAALTGFVLVPLSGYLVLGSSFLLTGFVALFHIRKIM
KTGGTNTEKLEKLMVKIGVFSILYTVPATCVIVCYVYERLNMDFWRLRATEQPCAAAAGPG TABLE 4-continued Targets from which the Analogs are derived GRRDCSLPGGSVPTVAVFMLKIFMSLVVGITSGVWVWSSKTFQTWQSLCYRKIAAGRARAK
ACRAPGSYGRGTHCHYKAPTVVLHMTKTDPSLENPTHL
(SEQ ID NO: 1322)

>gi|5032099|ref|NP_005622.1|smoothened homolog precursor {Homo sapiens}
MAAARPARGPELPLLGLLLLLLGDPGRGAASSGNATGPGPRSAGGSARRSAAVTGPPPPLS
HCGRAAPCEPLRYNVCLGSVLPYGATSTLLAGDSDSQEEAHGKLVLWSGLRNAPRCWAVIQ
PLLCAVYMPKCENDRVELPSRTLCQATRGPCAIVERERGWPDFLRCTPDRFPEGCTNEVQNI
KFNSSGQCEVPLVRTDNPKSWYEDVEGCGIQCQNPLFTEAEHQDMHSYIAAFGAVTGLCTLF
TLATFVADWRNSNRYPAVILFYVNACFFVGSIGWLAQFMDGARREIVCRADGTMRLGEPTS
NETLSCVIIFVIVYYALMAGVVWFVVLTYAWHTSFKALGTTYQPLSGKTSYFHLLTWSLPFV
LTVAILAVAQVDGDSVSGICFVGYKNYRYRAGFVLAPIGLVLIVGGYFLIRGVMTLFSIKSNH
PGLLSEKAASKINETMLRLGIFGFLAFGFVLITFSCHFYDFFNQAEWERSFRDYVLCQANVTIG
LPTKQPIPDCEIKNRPSLLVEKINLFAMFGTGIAMSTWVWTKATLLIWRRTWCRLTGQSDDEP
KRIKKSKMIAKAFSKRHELLQNPGQELSFSMHTVSHDGPVAGLAFDLNEPSADVSSAWAQH
VTKMVARRGAILPQDISVTPVATPVPPEEQANLWLVEAEISPELQKRLGRKKKRRKRKKEVC
PLAPPPELHPPAPAPSTIPRLPQLPRQKCLVAAGAWGAGDSCRQGAWTLVSNPFCPEPSPPQD
PFLPSAPAPVAWAHGRRQGLGPIHSRTNLMDTELMDADSDF
(SEQ ID NO: 1323)

>gi|6005762|ref|NP_009128.1|frizzled-10 precursor {Homo sapiens}
MQRPGPRLWLVLQVMGSCAAISSMDMERPGDGKCQPIEIPMCKDIGYNMTRMPNLMGHEN
QREAAIQLHEFAPLVEYGCHGHLRFFLCSLYAPMCTEQVSTPIPACRVMCEQARLKCSPIMEQ
FNFKWPDSLDCRKLPNKNDPNYLCMEAPNNGSDEPTRGSGLFPPLFRPQRPHSAQEHPLKDG
GPGRGGCDNPGKFHHVEKSASCAPLCTPGVDVYWSREDKRFAVVWLAIWAVLCFFSSAFTV
LTFLIDPARFRYPERPIIFLSMCYCVYSVGYLIRLFAGAESIACDRDSGQLYVIQEGLESTGCTL
VFLVLYYFGMASSLWWVVLTLTWFLAAGKKWGHEAIEANSSYFHLAAWAIPAVKTILILVM
RRVAGDELTGVCYVGSMDVNALTGFVLIPLACYLVIGTSFILSGFVALFHIRRVMKTGGENT
DKLEKLMVRIGLFSVLYTVPATCVIACYFYERLNMDYWKILAAQHKCKMNNQTKTLDCLM
AASIPAVEIFMVKIFMLLVVGITSGMWIWTSKTLQSWQQVCSRRLKKKSRRKPASVITSGGIY
KKAQHPQKTHHGKYEIPAQSPTCV
(SEQ ID NO: 1324)

>gi|8393378|ref|NP_059108.1|frizzled-3 precursor {Homo sapiens}
MAMTWIVFSLWPLTVFMGHIGGHSLFSCEPITLRMCQDLPYNTTFMPNLLNHYDQQTAALA
MEPFHPMVNLDCSRDFRPFLCALYAPICMEYGRVTLPCRRLCQRAYSECSKLMEMFGVPWP
EDMECSRFPDCDEPYPRLVDLNLAGEPTEGAPVAVQRDYGFWCPRELKIDPDLGYSFLHVRD
CSPPCPNMYFRREELSFARYFIGLISIICLSATLFTFLTFLIDVTRFRYPERPIIFYAVCYMMVSLI
FFIGFLLEDRVACNASIPAQYKASTVTQGSHNKACTMLFMILYFFTMAGSVWWVILTITWFL
AAVPKWGSEAIEKKALLFHASAWGIPGTLTIILLAMNKIEGDNISGVCFVGLYDVDALRYFVL
APLCLYVVVGVSLLLAGIISLNRVRIEIPLEKENQDKLVKFMIRIGVFSILYLVPLLVVIGCYFY
EQAYRGIWETTWIQERCREYHIPCPYQVTQMSRPDLILFLMKYLMALIVGIPSVFWVGSKKT
CFEWASFFHGRRKKEIVNESRQVLQEPDFAQSLLRDPNTPIIRKSRGTSTQGTSTHASSTQLA
MVDDQRSKAGSIHSKVSSYHGSLHRSRDGRYTPCSYRGMEERLPHGSMSRLTDHSRHSSSHR
LNEQSRHSSIRDLSNNPMTHITHGTSMNRVIEEDGTSA
(SEQ ID NO: 1325)

>gi|13994190|ref|NP_114072.1|frizzled-8 precursor {Homo sapiens}
MEWGYLLEVTSLLAALALLQRSSGAAAASAKELACQEITVPLCKGIGYNYTYMPNQFNHDT
QDEAGLEVHQFWPLVEIQCSPDLKFFLCSMYTPICLEDYKKPLPPCRSVCERAKAGCAPLMR
QYGFAWPDRMRCDRLPEQGNPDTLCMDYNRTDLTTAAPSPPRRLPPPPPGEQPPSGSGHGRP
PGARPPHRGGGRGGGGDAAAPPARGGGGGGKARPPGGGAAPCEPGCQCRAPMVSVSSER
HPLYNRVKTGQIANCALPCHNPFFSQDERAFTVFWIGLWSVLCFVSTFATVSTFLIDMERFKY
PERPIIFLSACYLFVSVGYLVRLVAGHEKVACSGGAPGAGGAGGAGGAAAGAGAAGAGAG
GPGGRGEYEELGAVEQHVRYETTGPALCTVVFLLVYFFGMASSIWWVILSLTWFLAAGMK
WGNEAIAGYSQYFHLAAWLVPSVKSIAVLALSSVDGDPVAGICYVNLGVRVFGFVLAPL
VIYLFIGTMFLLAGFVSLFRIRSVIKQQDGPTKTHKLEKLMIRLGLFTVLYTVPAAVVVACLFY
EQHNRPRWEATHNCPCLRDLQPDQARRPDYAVFMLKYFMCLVVGITSGVWVWSGKTLES
WRSLCTRCCWASKGAAVGGGAGATAAGGGGGPGGGGGGPGGGGPGGGGSLYSDVST
GLTWRSGTASSVSYPKQMPLSQV
(SEQ ID NO: 1326)

>gi|22547161|ref|NP_036325.2|frizzled-4 precursor {Homo sapiens}
MAWRGAGPSVPGAPGGVGLSLGLLLQLLLLLGPARGFGDEEERRCDPIRISMCQNLGYNVT
KMPNLVGHELQTDAELQLTTFTPLIQYGCSSQLQFFLCSVYVPMCTEKINIPIGPCGGMCLSV
KRRCEPVLKEFGFAWPESLNCSKFPPQNDHNHMCMEGPGDEEVPLPHKTPIQPGEECHSVGT
NSDQYIWVKRSLNCVLKCGYDAGLYSRSAKEFTDIWMAVWASLCFISTAFTVLTFLIDSSRFS
YPERPIIFLSMCYNIYSIAYIVRLTVGRERISCDFEEAAEPVLIQEGLKNTGCAIIFLLMYFFGMA
SSIWWVILTLTWFLAAGLKWGHEAIEMHSSYPHIAAWAIPAVKTIVILIMRLVDADELTGLCY
VGNQNLDALTGFVVAPLFTYLVIGTLFIAAGLVALFKIRSNLQKDGTKTDKLERLMVKIGVFS
VLYTVPATCVIACYFYEISNWALFRYSADDSNMAVEMLKIFMSLLVGITSGMWIWSAKTLHT
WQKCSNRLVNSGKVKREKRGNGWVKPGKGSETVV
(SEQ ID NO: 1327)

>gi|27894385|ref|NP_003459.2|frizzled-5 precursor {Homo sapiens}
MARPDPSAPPSLLLLLLAQLVGRAAAASKAPVCQEITVPMCRGIGYNLTHMPNQFNHDTQDE
AGLEVHQFWPLVEIQCSPDLRFFLCSMYTPICLPDYHKPLPPCRSVCERAKAGCSPLMRQYGF
AWPERMSCDRLPVLGRDAEVLCMDYNRSEATTAPPRPFPAKPTLPGPPGAPASGGECPAGGP

TABLE 4-continued

Targets from which the Analogs are derived

FVCKCREPFVPILKESHPLYNKVRTGQVPNCAVPCYQPSFSADERTFATFWIGLWSVLCFISTS
TTVATFLIDMERFRYPERPIIFLSACYLCVSLGFLVRLVVGHASVACSREHNHIHYETTGPALC
TIVFLLVYFFGMASSIWWVILSLTWFLAAGMKWGNEAIAGYAQYFHLAAWLIPSVKSITALA
LSSVDGDPVAGICYVGNQNLNSLRGFVLGPLVLYLLVGTLFLLAGFVSLFRIRSVIKQGGTKT
DKLEKLMIRIGIFTLLYTVPASIVVACYLYEQHYRESWEAALTCACPGHDTGQPRAKPEYWV
LMLKYFMCLVVGITSGVWIWSGKTVESWRRFTSRCCCRPRRGHKSGGAMAAGDYPEASAA
LTGRTGPPGPAATYHKQVSLSHV
(SEQ ID NO: 1328)

>gi|34734079|ref|NP_003497.2|frizzled-6 isoform a precursor {Homo sapiens}
MEMFTFLLTCIFLPLLRGHSLFTCEPITVPRCMKMAYNMTFFPNLMGHYDQSIAAVEMEHFL
PLANLECSPNIETFLCKAFVPTCIEQIHVVPPCRKLCEKVYSDCKKLIDTFGIRWPEELECDRLQ
YCDETVPVTFDPHTEFLGPQKKTEQVQRDIGFWCPRHLKTSGGQGYKFLGIDQCAPPCPNMY
FKSDELEFAKSFIGTVSIFCLCATLFTFLTFLIDVRRFRYPERPIFYYSVCYSIVSLMYFIGFLLGD
STACNKADEKLELGDTVVLGSQNKACTVLFMLLYFFTMAGTVWWVILTITWFLAAGRKWS
CEAIEQKAVWFHAVAWGTPGFLTVMLLAMNKVEGDNISGVCFVGLYDLDASRYFVLLPLCL
CVFVGLSLLLAGIISLNHVRQVIQHDGRNQEKLKKFMIRIGVFSGLYLVPLVTLLGCYVYEQV
NRITWEITWVSDHCRQYHIPCPYQAKAKARPELALFMIKYLMTLIVGISAVFWVGSKKTCTE
WAGFFKRNRKRDPISESRRVLQESCEFFLKHNSKVHKKKHYKPSSHKLKVISKSMGTSTGA
TANHGTSAVAITSHDYLGQETLTEIQTSPETSMREVKADGASTPRLREQDCGEPASPAASISRL
SGEQVDGKGQAGSVSESARSEGRISPKSDITDTGLAQSNNLQVPSSSEPSSLKGSTSLLVHPVS
GVRKEQGGGCHSDT
(SEQ ID NO: 1329)

For purposes of interpreting Table 4, please refer to the following legend:
Ac—Acylation
p-Cl-dF = para-Chlorine, D-Phenylalanine
4cl = Chlorinated Phenylalaine
$_dF$ = para-Chlorine, D-Phenylalanine
$_dR$ = D-Arginine
$_dY$ = D-Tyrosine
$_dA$ = D-Alanine
$_hR$ = homoarginine
pY = Phosphoroylated Tyrosine
pS = Phosphoroylated Serine
pE = Pyroglutamic acid
PEG = Polyetheythlene Glycol
PEG{number kD} = Polyetheythlene Glycol with a molecular weight near {number} in kilodaltons.
Nle = Noraleucine
$Nle$ = Noraleucine
$Y_m$ = methoxy-tyrosine.
$Y_M$ = methoxy-tyrosine.
$K_m$ = methalyated-lysine.
Aib = α-aminoisobutyric acid
Abu = ALPHA-AMINOBUTYRIC ACID
Gab = γ-aminobutyric acid;
Dip = β,β-diphenyl-L-alanine;
*= indicates cyclization between residues (lactam ring)
dHis = D-His
w = D-Tryptophan
Dnp = di-nitro-phenol
Mca = methoxycoumarin 4 acetic acid
Sar = sarcosine
Sta = statine
Ste = Stearyl
Pyr = pyroglutamic acid
Fam = carboxyfluoresceine
LC = —(NH$_2$—(CH$_2$)$_5$—C═O)—
TAMRA = carboxytetramethylrhodamine
T* = N-acetyl galactosamine labeled Thr
NH$_2$ = amidation of carboxy terminus
Orn = ornithine
K(W) = Trp residue which is coupled to the side chain of a Lys
Y(OMe) = methylated Tyrosine
Cit = citrulline
C6 = hexanoyl
Nva = Norvaline In some embodiments, analogs of the present invention (including any polypeptide sequence identified in Tables 1, 2, 3, or 4) are either be N-terminal acylated or an N-terminal free-amine. In some embodiments, analogs of the present invention are either a c-terminal amine or a c-terminal acid. These terminal groups do not preclude additional solubilization and/or stabilization attachments such a poly-ethylene glycol.

The following examples are provided to describe the invention in greater detail. They are intended to illustrate, not to limit, the invention. Various publications, including patents, published applications, technical articles and scholarly articles are cited throughout the specification. Each of these cited publications is incorporated by reference herein, in its entirety.

EXAMPLES

Example 1: Chemical Scheme to Synthesize Helical Polypeptides

This example describes how the polypeptide analogs may be designed prior to manufacture. The sequence of human vasoactive intestinal peptide (VIP) is given below, using the standard one-letter code for proteinogenic amino acid residues. For purposes of interpretation "position 1" of the sequence below is the N-terminal histidine. Each amino acid residue is numbered in sequence from the N-terminal end of the polypeptide to the C-terminal. Therefore, "position 28" of the sequence below is the C-terminal asparagine.

HSDAVFTDNYTRLRKQMAVKKYLNSILN     (SEQ ID NO: 10)

Design A.

A family of the following VIP analogues were synthesized each containing at least two alpha to β³ replacements per seven α-amino acid residues of VIP:

HSDAV FTDNY TRLRK QLAVK KYLNA ILN    (SEQ ID NO: 1342)
HSDAV FTDNY TRLRK QLAVK KYLNA ILN    (SEQ ID NO: 1342)
HSDAV FTDNY TRLRK QLAVK KYLNA ILN    (SEQ ID NO: 1342)
HSDAV FTDNY TRLRK QLAVK KYLNA ILN    (SEQ ID NO: 1342)
HSDAV FTDNY TRLZK QLXVK KYLNX ILN    (SEQ ID NO: 1343)
HSDAV FTDNY TRLZK QLXVK ZYLNX ILN    (SEQ ID NO: 1344)
HSDAV FTDNY XRLZK QLXVK KYLNX ILN    (SEQ ID NO: 1345)
HSDAV FTDNY XRLZK QLXVK ZYLNX ILN    (SEQ ID NO: 1346)
HSDAV FTDNY TRLRZ QLXVK KYLNX ILN    (SEQ ID NO: 1347)

HSDAV FTDNY XRLRZ QLXVK KYLNX ILN    (SEQ ID NO: 1348)
HSDAV FTDNY TRLZK QLAVK ZYLXA ILN    (SEQ ID NO: 1349)
HSDAV FTDNY TRLZK QXAVK KYLXA ILN    (SEQ ID NO: 1350)
HSDAV FTDNY TRLZK QXAVK ZYLXA ILN    (SEQ ID NO: 1351)

In each of sequences above, at least one β-3 residue has been replaced by a cyclic or heterocyclic residue. In some embodiments, based upon the above sequences, X=ACPC, Z=APC; uncharged side chains replaced by ACPC, basic side chains replaced by APC, Protected β3-amino acids); the positions indicated with bold and underlined letters are those at which β-to-β3 replacement has occurred. Reagents for α/β-Peptide synthesis (Fmoc on the backbone nitrogen and appropriate protecting groups on side chains, when necessary) will be obtained from commercial suppliers or prepared via reported methods in Horne et. al. PNAS, Sep. 1, 2009, vol. 106, no. 35, 14751-14756. Each β3-amino acid residue bore the side chain of the β-amino acid found at that site in the VIP sequence. Thus, for example, analogues that contain a β-residue at position 10 of the sequence had a β3-homotyrosine at this position, in place of the tyrosine at position 10 of VIP itself. The analogues shown above were synthesized manually by microwave-assisted Fmoc solid phase peptide synthesis on NovaSyn TGR resin. Coupling steps were carried out with a three-fold excess of the appropriate protected α- or β3-amino acid, using HBTU and HOBt to mediate amide bond formation. Piperidine was used for Fmoc deprotection steps. Each peptide was cleaved from resin by treatment with 94:2.5:2.5 TFA/H2O/triisopropylsilane, precipitated by addition of cold ethyl ether, and purified by reverse phase HPLC on a prep-C18 column using gradients between 0.1% TFA in water and 0.1% TFA in acetonitrile. The identity and purity of the HSDAVFTDNYXRLZKQLXVKZYLNXILN (Compound 8) was determined by MALDI-TOF-MS and analytical HPLC, respectively. Data from the MALDI-TOF-MS analysis showing the expected mass values is shown in FIG. 1. The sample was examined by MALDI-TOF to determine molecular weight. A 50:50 mixture of acetonitrile/water was used to dissolve alpha cyano-cinnamic acid matrix together with a 5 uM aliquot of sample. The sample was dried on an appropriate sample plate and examined in positive, reflectron mode with a 25 KV voltage, 100 mV electronic gain and a laser frequency of 60 Hz. The resulting spectra demonstrated an observed mass (mass/charge, m/z) of 3351.4 which compares favorably with the expected mass of 3350.79. In addition, the observed doubly charged species, (Z=2) of 1675.684 was also observed and compares favorably to the expected '+2' peak of 1675.395.

Design B (Prophetic).

A family of analogues will be prepared, each containing two alpha to β³ replacements per seven α-amino acid residues of VIP. Each β³-amino acid residue will bear the side chain of the α-amino acid found at that site in the VIP sequence. Thus, for example, analogues that contain a β-residue at position 4 of the sequence will have β³-homoalanine at this position, in place of the alanine at position 4 of VIP itself. The analogues to be prepared are shown below; the positions indicated with bold and underlined letters are those at which α-to-β³ replacement has occurred.

HSDAVFTDNYTRLRKQMAVKKYLNSILN    (SEQ ID NO: 10)
HSDAVFTDNYTRLRKQMAVKKYLNSILN    (SEQ ID NO: 10)
HSDAVFTDNYTRLRKQMAVKKYLNSILN    (SEQ ID NO: 10)
HSDAVFTDNYTRLRKQMAVKKYLNSILN    (SEQ ID NO: 10)
HSDAVFTDNYTRLRKQMAVKKYLNSILN    (SEQ ID NO: 10)
HSDAVFTDNYTRLRKQMAVKKYLNSILN    (SEQ ID NO: 10)
HSDAVFTDNYTRLRKQMAVKKYLNSILN    (SEQ ID NO: 10)
HSDAVFTDNYTRLRKQLAVKKYLNAILN    (SEQ ID NO: 1342)
HSDAVFTDNYTRLRKQLAVKKYLNAILN    (SEQ ID NO: 1342)
HSDAVFTDNYTRLRKQLAVKKYLNAILN    (SEQ ID NO: 1342)
HSDAVFTDNYTRLZKQLXVKZYLNXILN    (SEQ ID NO: 1344)
HSDAVFTDNYXRLZKQLXVKKYLNXILN    (SEQ ID NO: 1345)
HSDAVFTDNYXRLZKQLXVKZYLNXILN    (SEQ ID NO: 1346)
HSDAVFTDNYTRLZKQLAVKZYLXAILN    (SEQ ID NO: 1349)
HSDAVFTDNYTRLZKQXAVKKYLXAILN    (SEQ ID NO: 1350)
HSDAVFTDNYTRLZKQXAVKZYLXAILN    (SEQ ID NO: 1351)
HSDAVFTDNYXRLRKQLAVKKYLNAILN    (SEQ ID NO: 1367)
HSDAVFTDNYTRLKQLAVKKYLNAILN    (SEQ ID NO: 1368)
HSDAVFTDNYTRLRKQLXVKKYLNAILN    (SEQ ID NO: 1369)
HSDAVFTDNYTRLRKQLAVKKYLNAILN    (SEQ ID NO: 1370)
HSDAVFTDNYTRLRKQLAVKKYLNXILN    (SEQ ID NO: 1371)
HSDAVFTDNYXRLZKQLXVKZYLNXILN    (SEQ ID NO: 1346)
HSDAVFTDNYTRLR RQLAARRYLNAIKK    (SEQ ID NO: 1372)

In each of sequences above, at least one β-3 residue has been replaced by a cyclic or heterocyclic residue. In some embodiments, based upon the above sequences, X=ACPC, Z=APC; uncharged side chains replaced by ACPC, basic side chains replaced by APC, Protected β³-amino acids). α/β-Peptide synthesis (Fmoc on the backbone nitrogen and appropriate protecting groups on side chains, when necessary) will be obtained from commercial suppliers or prepared via reported methods. Each β³-peptide will be prepared manually by microwave-assisted Fmoc solid phase peptide synthesis on NovaSyn TGR resin. Coupling steps will be carried out with a three-fold excess of the appropriate protected α- or β³-amino acid, using HBTU and HOBt to mediate amide bond formation. Piperidine will be used for Fmoc deprotection steps. Each peptide will be cleaved from resin by treatment with 94:2.5:2.5:1 TFA/H2O/ethanedithiol/triisopropylsilane, precipitated by addition of cold ethyl ether, and purified by reverse phase HPLC on a prep-C18 column using gradients between 0.1% TFA in water and 0.1% TFA in acetonitrile. The identity and purity of the final products will be determined by MALDI-TOF-MS and analytical HPLC, respectively.

Design and Synthesis of VPAC₁-Selective VIP Analogues.

VPAC₁-selective VIP analogues will be synthesized in accordance with the protocol outlined above. The predicted α-helical portion of VIP polypeptide is from positions 10-28 which are depicted:

Helical wheel diagram for VIP 10-28
(the portion that is α-helical)

The amino acid residues will be substituted with non-natural amino acid residues. β³-amino acid residue positions indicated in bold and underline, and, on the helical wheel diagram below (corresponding go the positions on the diagram of VIP above), β³-amino acid residue positions indicated as solid dots. In some species, the non-polar β³-residues (e.g., β³-hAla, β³-hVal) will be replaced by (S,S)-trans-2-aminocyclopentanecarboxylic acid ((S,S)-ACPC), while basic β³-residues (such as β³-hLys or β³-hArg) will be replaced by APC:

HSDAV FTDNY ARLRK QMAVK KALNS ILA (SEQ ID NO: 435)

HSDAV FTDNY ARLRK QMAVK KALNS ILA (SEQ ID NO: 435)

HSDAV FTDNY ARLRK QMAVK KALNS ILA (SEQ ID NO: 435)

HSDAV FTDNY ARLRK QMAVK KALNS ILA (SEQ ID NO: 435)

HSDAV FTDNY ARLRK QMAVK KALNS ILA (SEQ ID NO: 435)

HSDAV FTDNY ARLRKQ MAVK KALNS ILA (SEQ ID NO: 435)

HSDAV FTDNY ARLRKQ MAVK KALNS ILA (SEQ ID NO: 435)

HSDAV FTDNY ARLRKQ MAVK KALNS ILA (SEQ ID NO: 435)

HADAV FTAAY ARLRK QMAAK KALAA IAA (SEQ ID NO: 434)

α/β-Peptide analogues below will be synthesized:

HADAV FTAAY ARLRK QMAAK KALAA IAA (SEQ ID NO: 434)

HADAV FTAAY ARLRK QMAAK KALAA IAA (SEQ ID NO: 434)

HADAV FTAAY ARLRK QMAAK KALAA IAA (SEQ ID NO: 434)

HADAV FTAAY ARLRK QMAAK KALAA IAA (SEQ ID NO: 434)

HADAV FTAAY ARLRKQ MAAK KALAA IAA (SEQ ID NO: 434)

HADAV FTAAY ARLRKQ MAAK KALAA IAA (SEQ ID NO: 434)

HADAV FTAAY ARLRKQ MAAK KALAA IAA (SEQ ID NO: 434)

Designs Targeted Toward the VPAC₂ Receptor-Selective Analogues.

VPAC₁-selective VIP analogues will be synthesized in accordance with the protocol outlined above. α-helical portion of VIP polypeptide sequences will be substituted with non-natural amino acid residues where β³-amino acid residue positions indicated in bold and underlined. In some species, the non-polar β³-residues (e.g., β³-hAla, β³-hVal) will be replaced by (S,S)-trans-2-aminocyclopentanecarboxylic acid ((S,S)-ACPC), while basic β³-homo residues (such as β³-hLys or β³-hArg) will be replaced by the pyrrolidine analogue of (S,S)-ACPC, which is designated APC (Note: Ac=acetyl; N$^{le}$=norleucine; K*---D* indicates that the side chains of these two residues may be linked via an amide bond.)

a/b-Peptide analogues will be synthesized:

(SEQ ID NO: 1373)
Ac-HSDAV FTENY TKLRK QN$^{le}$AVK K*YLND* LKKGG T

(SEQ ID NO: 1373)
Ac-HSDAV FTENY TKLRK QN$^{le}$AVK K*YLND* LKKGG T

(SEQ ID NO: 1373)
Ac-HSDAV FTENY TKLRK QN$^{le}$AVK K*YLND* LKKGG T (SEQ ID NO: 1373)
Ac-HSDAV FTENY TKLRK QN$^{le}$AVK K*YLND* LKKGG T (SEQ ID NO: 1373)
Ac-HSDAV FTENY TKLRK QN$^{le}$AVK K*YLND* LKKGG T (SEQ ID NO: 1373)
Ac-HSDAV FTENY TKLRK QN$^{le}$AVK K*YLND* LKKGG T (SEQ ID NO: 1373)
Ac-HSDAV FTENY TKLRK QN$^{le}$AVK K*YLND* LKKGG T (SEQ ID NO: 1374)
Ac-HSDAV FTENY TKLRK RN$^{le}$AAK N$^{le}$LNN LKKGG T

(SEQ ID NO: 1374)
Ac-HSDAV FTENY TKLRK RN$^{le}$AAK N$^{le}$YLNN LKKGG T

(SEQ ID NO: 1374)
Ac-HSDAV FTENY TKLRK RN$^{le}$AAK N$^{le}$YLNN LKKGG T

-continued (SEQ ID NO: 1374)
Ac-HSDAV FTENY TKLRK RN$^{le}$AAK N$^{le}$YLNN LKKGG T (SEQ ID NO: 1374)
Ac-HSDAV FTENY TKLRK RN$^{le}$AAK N$^{le}$YLNN LKKGG T (SEQ ID NO: 1374)
Ac-HSDAV FTENY TKLRK RN$^{le}$AAK N$^{le}$YLNN LKKGG T (SEQ ID NO: 1374)
Ac-HSDAV FTENY TKLRK RN$^{le}$AAK N$^{le}$YLNN LKKGG T wherein Ac=acetyl; N$^{le}$=norleucine; K*---D* indicates that the side chains of these two residues may be linked via an amide bond.

One purpose of this study will be to demonstrate that the analogs of the application may be designed to increase the half-life of the polypeptide as compared to the half-life of the naturally encoded protein by introducing non-natural amino acid analogs that are resistant to degradation and/or induce an equivalent or increased bioactivity as compared to the naturally encoded polypeptide sequence upon which the analog is based or derived through the possible incorporation of conformationally-constrained residues.

Example 2: Structural Analysis of Helical Polypeptides

Structural Analysis A

This example describes how a VIP analogue was characterized after chemical synthesis and purification.

Figure 2:
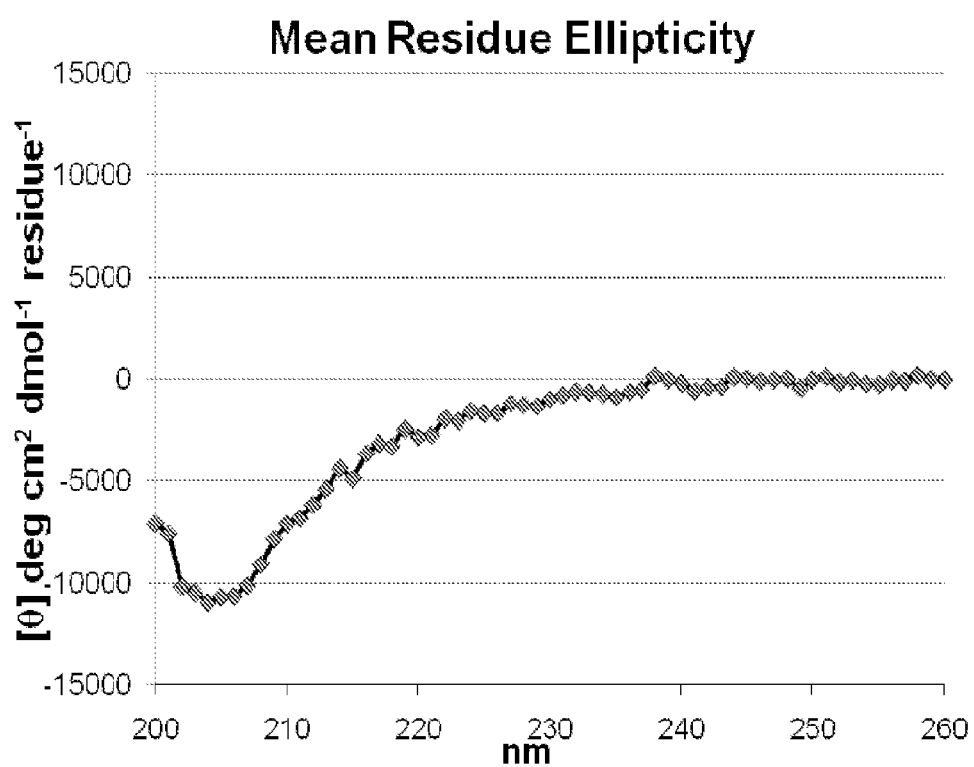
FIG. 2 presents circular dichroism data of a VIP analogue diluted in a 10 mM sodium phosphate buffer at pH of 7.5. The signal exhibited for the structure of the VIP analogue is similar to previously characterized α-amino acid/β amino acid peptides of similar backbone length and concentration, which indicates a substantial helical content (Horne et. al., J. Am. Chem. Soc., 2007, 129 (14), pp 4178-4180; Horne et. al. PNAS, Sep. 1, 2009, vol. 106, no. 35, 14751-14756).

Circular Dichroism Spectroscopy. Circular dichroism measurements were carried out on a Aviv 202SF Circular Dichroism Spectrophotometer (FIG. 2). Samples of each peptide were prepared with a determined UV absorbance in the range of 0.1-1.0 at 280 nm in a phosphate-buffered solution at a pH of 7.5 for a final concentration of about 14 µM. The analogue was transferred a 0.1 cm path length cell for measurement. Wavelength scans were carried out with a 1 nm step and 8 sec averaging time, in quadruplicate at 23° C. All spectra were corrected against buffer measured in the same cell.

The data of FIG. 2 demonstrate the expected circular dichroism measurements of an alpha-beta hybrid polypeptide. The results are consistent with previously published data of an alpha-beta hybrid polypeptide that has similar backbone length and similar beta-amino acid percent and similar sample concentration.

Structural Analysis B (Prophetic)

This prophetic example describes how the polypeptide analogs of this invention may be characterized after manufacture through structural conformational assays such as circular dichrosim (CD) and Nuclear magnetic resonance (NMR).

Circular Dichroism Spectroscopy. Circular dichroism measurements will be carried out on an Aviv 202SF Circular Dichroism Spectrophotometer. Samples of each peptide will be prepared with a determined UV absorbance in the range of 0.1-1.0 at 280 nm in a pH buffered solution. Spectra will be recorded in a 1 mm cell with a step size of 1 nm and an averaging time of 5 sec. All spectra will be background corrected against buffer measured in the same cell. Thermal melts will be carried out in 1-degree increments with an equilibration time of 2 min between each temperature change. Thermal unfolding data will be fit to a simple two state folding model Shortie, D. Meeker, A. K. Freire, E. *Biochemistry* 1988, 27, 4761-4768) using GraphPad Prism.

Nuclear Magnetic Resonance: Structure elucidation of the proposed analogs can also be accomplished based on analyses of heteronuclear NMR experimental data. Global backbone structural information complementing the local structure information provided by backbone chemical-shift assignments can be obtained from nuclear Overhauser effect spectroscopy (NOESY) which yield atomic distance constraints together with residual dipolar coupling (RDC) experiments which provide orientation restraint information. Together, these techniques can be used to provide valuable structural information regarding the positioning and alignment of the amino acids within the polypeptide analog. Samples of each peptide or analog will be prepared with a determined UV absorbance in the range of 0.1-1.0 at 280 nm in an appropriate pH buffered solution. Each preparation will then be used to conduct NOESY and RDC experiments using standard NMR equipment (i.e. Bruker NMR) and data analysis software (i.e. Talos+). Further structural insight can be ascertained by comparing the results of NMR experiments in the presence and absence of the intended binding partner.

One purpose of this study is to evidence that the conformation of the analog is structurally constrained and that certain non-natural amino acids have been incorporated in the synthesized peptide in their predicted location along a longitudinal axis of the polypeptide.

Example 3: Stability Analysis of Helical Polypeptides in Solution (Prophetic)

This prophetic example describes how the solubility of the polypeptide analogs of this invention may be characterized after manufacture through assays such as a protease resistance assay.

In Vitro Stability Assay: Stock solutions of the both the naturally occurring peptides as well as peptide analogs will be prepared at a concentration of 25 µM (based on UV absorbance) in appropriate buffer. A solution of proteinase K in addition to other common animal proteases (i.e. Cathepsins and Trypsins) will be prepared at an appropriate concentration of 50 µg/mL (based on weight to volume) in appropriate buffer. For each proteolysis reaction, 40 µL of peptide stock will be mixed with 10 µL of protease stock. The reaction will be allowed to proceed at room temperature and quenched at the desired time point by addition of 100 µL of 1% TFA in water. 125 µL of the resulting quenched reaction will be injected onto an analytical reverse phase HPLC, and the amount of starting peptide present quantified by integration of the appropriate chromatogram peak via absorbance at either 220 or 280 nm. Duplicate reactions will be run for each time point. Half-lives will be determined by fitting time dependent peptide concentration to an exponential decay using GraphPad Prism. Samples for some time points will be analyzed by MALDI-MS, and the products observed will be used to identify amide bonds cleaved in the course of the reaction. The relative stability enhancement will be determined through the comparison of the various analogs with its naturally occurring peptide counterpart.

In Vivo Stability Assay: To investigate the in vivo stability of the analogs, both the naturally occurring peptide as well as the analogs will be administered to mice and/or rats by IV, IP, SC, PO and/or inhalation routes at concentrations ranging from 0.001 to 50 mg/kg and blood specimens withdrawn at 0 minutes, 5 minutes, 15 minutes, 30 minutes, 1 hr, 4 hrs, 8 hrs, 12 hrs, 24 hrs and 48 hrs post-injection. Levels of intact compound in 25 µL of fresh serum will then be injected onto an analytical reverse phase HPLC, and the amount of starting peptide present quantified by integration of the appropriate chromatogram peak via absorbance at either 220 or 280 nm or other means of measuring the presence or absence of fully intact analog as described herein. The expected molecular weights will be determined through either LC/MS or MALDI/TOF analysis. This analysis technique also allows the examination of the in-vivo metabolites by determination of fragment molecular weights. The relative stability enhancement will be determined through the comparison of the various analogs with its naturally occurring peptide counterpart.

Cassette Dosing and Serum Analysis for Determination of Bioavailability: The oral bioavailability will be screened by dosing rats with a cassette, i.e. mixture of 1-5 analogs per dosing solution. The cassette includes 1-5 test articles and a standard compound, for a total dose of 10 mg/kg. Each compound/test article will be converted to an appropriate salt form and dissolved in water at 2 mg/mL. The cassette will be prepared by mixing equal volumes of each of the two-six solutions. The cassette dosing solution should be mixed well and then the pH should be adjusted to 7.5-9. The dosing solution should be prepared the day before the study and stirred overnight at room temperature.

Male Sprague Dawley (SD) rats, 6-8 weeks old, will be used in this screen. Rats will be quarantined for at least one day and have continuous access to food and water. On the night before the administration of the cassette, the rats will be fasted for approximately 16 h.

Four SD rats will be assigned in each cassette. A single dose of the dosing solution will be administered orally to each rat. The dosing volume (5 mL/kg) and time will then be recorded and rats will be fed 2 h after dosing.

Blood samples will be collected via cardiac puncture at the following time points: 4 h, 8 h and 12 h. Immediately prior to blood collection, rats will be anesthetized with $CO_2$ gas within 10-20 seconds. After the 12-hour samples are collected, the rats will be euthanized via $CO_2$ asphyxiation followed by cervical dislocation.

Blood samples will be kept in heparinized microtainer tubes under subambient temperature (4° C.) before they are processed. Blood samples will be centrifuged (10,000 rpm for 5 minutes) and plasma samples should be removed and stored in a −20° C. freezer until analyzed for analog levels. Analog levels in the plasma will be analyzed using the following protocol for direct plasma precipitation.

The in vivo plasma samples will be prepared in a 1.5 mL 96-well plate, by adding, in order, 100 µL of the test plasma, 150 µL of methanol, followed by vortexing for 10-20 seconds. 150 µL of 0.05 ng/µL of an Internal Standard in acetonitrile shall be added and vortexed for 30 seconds.

The standard curve samples were prepared in a 1.5 mL 96-well plate, by adding, in order, 100 µL of control mouse plasma, followed by 150 µL of methanol and vortexing for 10-20 seconds. 150 µL of 0.05 ng/µL of an Internal Standard in acetonitrile shall be added and vortexed for 30 seconds. The samples will then be spiked with 0-200 ng (10 concentrations) of the compound of interest in 50% methanol to obtain a standard curve range of 0.5 ng/mL to 2,000 ng/mL. Again, the sample is vortexed for 30 seconds.

The samples should then be centrifuged for 20-30 minutes at 3,000 rpm in an Eppendorf microfuge before 80-90% of supernatant is transferred into a clean 96-well plate. The organic solvent will then be evaporated until the samples are dry (under $N_2$ at 40° C./30-60 min. (ZymarkTurbovap)).

The residue will then be dissolved in 200-600 L mobile phase (50% $CH_3OH$/0.1% TFA). LC/MS/MS will then be run using a mass spectrometer with pump. Dataanalysis and quantification accomplished using PE-Sciex Analyst (v 1.1). A 5-50 µl sample volume will be injected onto a reverse phase column (Keystone 2.0×20 mm, 5 µm, PN: 8823025-701) using a mobile phase of 25% $CH_3OH$, 0.1% TFA-100% $CH_3OH$, 0.1% TFA. The run time will be about 8 minutes at a flow rate of about 300 µL/minutes. The Area Under the Curve (AUC) will be calculated using the linear trapezoidal rule from t=0 to the last plasma concentration sampling time tx (see Handbook of Basic Pharmacokinetics, Wolfgang A. Ritschel and Gregory L. Kearns, 5th ed, 1999). $AUC^0\text{-}tx = \Sigma^0\text{-}n((C_n + C_n+1)/2))(t_n+1-t_n)$ {in (µg/mL)h}

In the case of the cassette dosing paradigm, samples at 4, 8 and 12 h post extravascular dosing, the AUC will be calculated from t=0 to t=12 h. Each of the analogs above when tested in this assay should provide for an AUC of at least 5 µgh/mL when normalized for administration at a 10 mg/kg dose.

One purpose of this study is to evidence that the analog is more resistant to peptidases as compared to the resistance of similarly-structured, naturally occurring polypeptides upon which the structure of the analog is based or derived. The results may show that, when treated with the same proteolytic enzymes, the analogs of the invention will resist degradation and have longer half-lives than similarly-structured, naturally occurring polypeptides upon which the structure of the analog is based or derived.

Example 4: Functional Analysis of Helical Polypeptides

This prophetic example describes the function of polypeptide analogs of this invention may be characterized after manufacture through assays that measure bioactivity of the analogs when exposed to tissue culture or when administered to an animal model of one of the following human disease states: COPD, pulmonary hypertension, primary arterial hypertension, pulmonary hypertension associated to post-ventricular septal defect, idiopathic pulmonary fibrosis, idiopathic pulmonary arterial hypertension, CREST syndrome—Calcinosis; Raynaud's disease; loss of muscle control of the Esophagus; Sclerodactyly; Telangiectasia, Acute respiratory distress, congestive heart failure, chronic obstructed pulmonary disorder, asthma, chronic obstructive pulmonary disease, sarcoidosis, small cell lung cancer, autoimmune disease, inflammatory disease, sepsis, Hirschsprung's Disease, sexual dysfunction, erectile dysfunction, Parkinson's disease, Alzheimer's disease, circadian rhythm dysfunction, pain, colorectal cancer, hepatocellular cancer, elevated blood pressure levels, elevated blood glucose levels, elevated blood pressure levels, hyperglycemia, diabetes, insulin resistance, metabolic acidosis, obesity, Type I diabetes, Type II diabetes Multiple Sclerosis, osteoporosis, Sjogren's syndrome, pancreatitis, uveoretinitis, osteoporosis, female sexual dysfunction.

In Vitro Binding Assay 1: A VIP analogue (Compound 8) in appropriate phosphate buffer was at pH of 7.5 was exposed to a functional assay in parallel with wild-type VIP proteins. cAMP Hunter cell lines expressing VIPR1 and VIPR2 were expanded from freezer stocks in T25 flasks according to standard procedures and maintained in selective growth media prior to assay. Once it was established that the cells were healthy and growing normally, cells were passaged from flasks using cell dissociation reagent buffer and seeded into white walled clear bottom 384-well microplates for compound profiling. For profiling, cells were seeded at a density of 10,000 cells per well in a total volume of 20 µL and were allowed to adhere and recover overnight prior to compound addition. cAMP modulation was determined using the DiscoveRx HitHunter cAMP XS+ assay.

Figure 3:
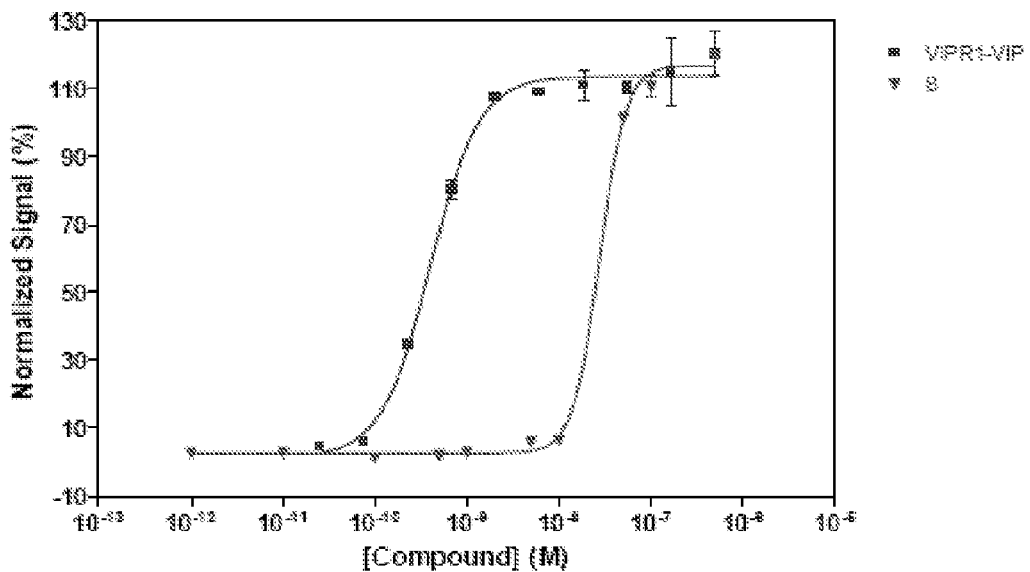
FIG. 3 illustrates in vitro functional $EC_{50}$ data of a VIP analogue tested in the presence of VIPR1 ($VPAC_1$) or VIPR2 ($VPAC_2$) receptors as compared to the binding of wild-type VIP protein to the same receptors. The data show that the analogue achieves full activation of VIPR1 (~100%, relative to maximum activation), but has an $EC_{50}$ at a concentration higher than the $EC_{50}$ of wild-type VIP protein.
Figure 3:
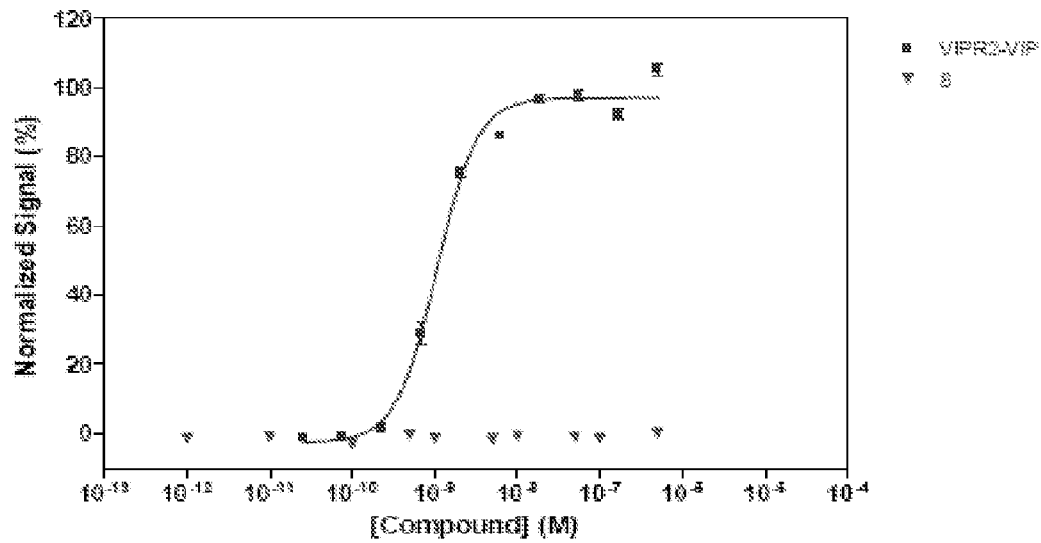

For profiling compound in agonist mode, the cells were incubated in the presence of compound at 37° C. for 30 minutes. Cells expressing both VIPR1 and VIPR2 were exposed to serial dilutions of wild-type VIP and separate samples of the same type of cells were exposed to serial dilutions of VIP analogue (Compound 8) to determine $EC_{50}$ values of the analogue as compared to wild-type VIP (FIG. 3). After appropriate compound incubation, assay signal was generated through incubation with DiscoverX lysis cocktail according to the manufacturers standard protocol. Dose curves were plotted using GraphPad Prism or Activity Base. Percentage activity is calculated using the following formula:

% Activity=100%×(mean RLU of test sample−mean RLU of vehicle control)/(mean RLU of MAX control−mean RLU of vehicle control).

Data from FIG. 3 demonstrates that Compound 8 was able to fully activate VIPR1, but not activate VIPR2. The following $EC_{50}$ values were measured (peptide concentration for 50% VIPR1 activation):

VIP: 0.4 nM
Compound 8: 28 nM

Compound 8 apparently does not interact substantially with VIPR2. Raw fluorescence data of measurements taken from the agonist binding experiments performed in triplicate appears below in Table 5.

TABLE 5

VIP Analogue Agonist $EC_{50}$ determination.

| [Compound] (M) | Mean RLU | SD | % CV | Readout cAMP Mode Agonist % Activity |
|---|---|---|---|---|
| Compound ID VIP [Starting] 0.50 µM Cell Line VIPR1 | | | | |
| 5.00E−07 M | 112760.0 | 7863.0 | 7.0% | 100.0% |
| 1.67E−07 M | 135220.0 | 12190.5 | 11.3% | 95.6% |
| 5.56E−08 M | 134420.0 | 2121.3 | 2.0% | 91.9% |
| 1.85E−08 M | 134480.0 | 5430.6 | 5.2% | 91.9% |
| 6.17E−09 M | 132640.0 | 395.0 | 0.4% | 90.4% |
| 2.06E−09 M | 131520.0 | 1301.1 | 1.3% | 89.1% |
| 6.66E−10 M | 76020.0 | 3422.4 | 4.4% | 65.2% |
| 2.29E−10 M | 36240.0 | 1414.3 | 3.7% | 27.5% |
| 7.62E−11 M | 13260.0 | 1215.3 | 9.2% | 3.2% |
| 2.54E−11 M | 11960.0 | 3.0 | 0.0% | 2.0% |
| 0.00E+00 M | 9920.0 | 843.5 | 5.5% | 0.0% |
| S/B | 11.4 | AvCV | 4.5% | |
| Compound ID 8 [Starting] 0.50 µM Cell Line VIPR1 | | | | |
| 5.03E−07 M | 112320.0 | 1640.5 | 1.5% | 99.5% |
| 1.03E−07 M | 104400.0 | 3733.5 | 3.6% | 91.7% |
| 5.03E−08 M | 96460.0 | 1612.2 | 1.7% | 83.9% |
| 1.03E−08 M | 13700.0 | 537.4 | 3.9% | 1.5% |
| 5.03E−09 M | 13200.0 | 339.4 | 2.6% | 1.2% |
| 1.03E−09 M | 13500.0 | 1074.5 | 10.1% | −1.4% |
| 5.03E−10 M | 9520.0 | 1566.5 | 15.8% | −2.2% |
| 1.03E−10 M | 9960.0 | 56.5 | 0.6% | −2.9% |
| 1.03E−11 M | 10500.0 | 424.3 | 4.0% | −1.5% |
| 1.03E−12 M | 10340.0 | 537.4 | 5.2% | −1.7% |
| 0.00E+00 M | 12040.0 | 396.0 | 3.3% | 0.3% |
| S/B | 9.3 | AvCV | 4.9% | |
| Compound ID 9 [Starting] 0.50 µM Cell Line VIPR2 | | | | |
| 5.00E−07 M | 10200.0 | 622.3 | 8.1% | 1.9% |
| 1.00E−07 M | 8920.0 | 1527.4 | 17.1% | 0.4% |

TABLE 5-continued

VIP Analogue Agonist $EC_{50}$ determination.

| [Compound] (M) | Mean RLU | SD | % CV | Readout cAMP Mode Agonist % Activity |
|---|---|---|---|---|
| 5.00E−08 M | 9200.0 | 1527.4 | 15.6% | 0.9% |
| 1.00E−08 M | 9560.0 | 64.9 | 3.9% | 1.2% |
| 5.00E−09 M | 8560.0 | 1329.4 | 15.4% | 0.1% |
| 1.00E−09 M | 8560.0 | 28.3 | 0.3% | 0.4% |
| 5.00E−10 M | 3920.0 | 676.8 | 9.9% | 1.5% |
| 1.00E−10 M | 7560.0 | 1414.2 | 18.7% | −1.1% |
| 1.00E−11 M | 3280.0 | 113.1 | 1.2% | 0.9% |
| 1.00E−12 M | 9300.0 | 594.0 | 6.7% | 0.4% |
| 0.00E+00 M | 9540.0 | 26.3 | 0.3% | 0.3% |
| S/B | 1.2 | AvCV | 7.7% | |

In Vitro Competition Assay 1: Antagonist Dose curves were calculated by first providing a VIP analogue (Compound 8) in appropriate phosphate buffer at pH of 7.5. Cells expressing both VIPR1 and VIPR2 were exposed to serial dilutions of VIP analogue (Compound 8) in combination with wild-type VIP to determine the level of inhibition of VIPR1 and VIPR2 (FIG. 4). cAMP Hunter cell lines expressing VIPR1 and VIPR2 were expanded from freezer stocks in T25 flasks according to standard procedures and maintained in selective growth media prior to assay. For profiling, cells were seeded according to manufacturer protocol using a cAMP modulation assay with the DiscoveRx HitHunter cAMP XS+ assay.

Before treatment of the cells, media was aspirated from cells and replaced with DiscoverX antibody solution according to their standard protocol. Agonist dose curves were performed to determine the EC80 value for the following antagonist testing with compounds. For antagonist determination, cells were pre incubated with Compound 8 followed by VIP challenge at the EC80 concentration of 2.2 nM. 5 µL of 4× Compound 8 was added to cells and incubated at 37° C. for 30 minutes. 5 µL of 4× EC80 VIP agonist was added to cells and incubated at 37° C. for 30 minutes.

Figure 4:
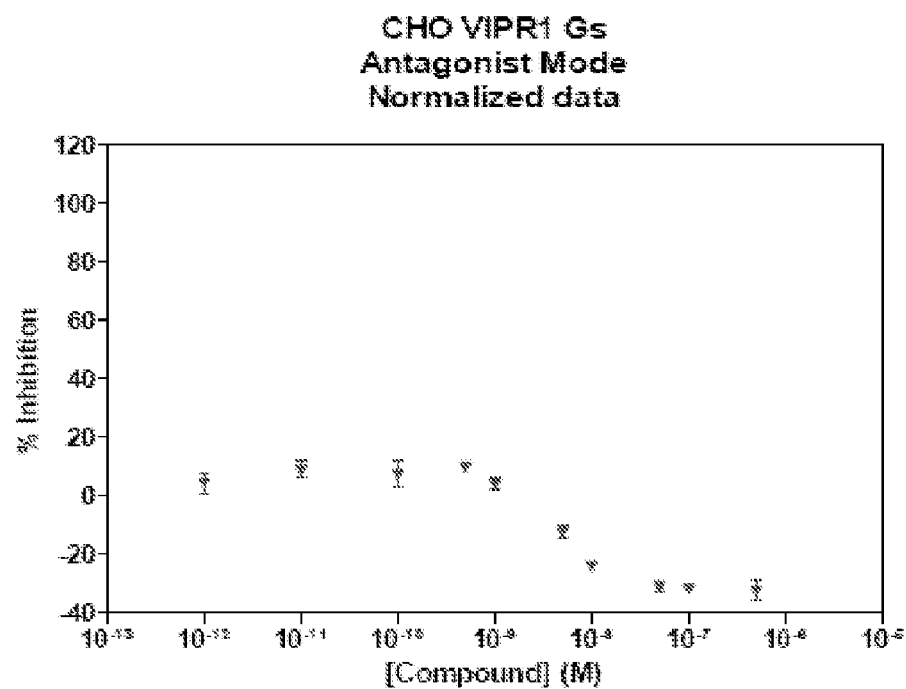
FIG. 4 illustrates data from an in vitro antagonist inhibition assay in which competition for VIPR1 ($VPAC_1$) or VIPR2 ($VPAC_2$) was measured by the amount of VIP analogue capable of inhibiting the association of wild-type VIP to its receptors.
Figure 4:
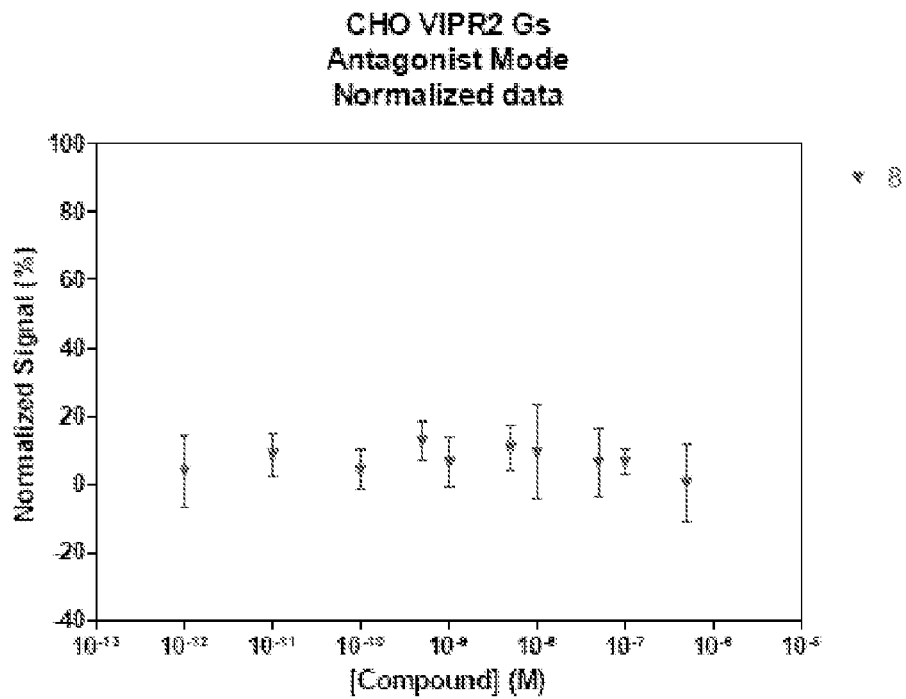

After appropriate compound incubation, assay signal was generated through incubation with DiscoverX lysis cocktail according to the manufacturers standard protocol. Dose curves were plotted using GraphPad Prism or Activity Base. Dose curves were plotted using GraphPad Prism or Activity Base. FIG. 4, Panel A, shows a percent inhibition of VIPR1 by Compound 8. For antagonist mode assays, percentage inhibition is calculated using the following formula:

% Inhibition=100%×(1−(mean RLU of test sample−mean RLU of vehicle control)/(mean RLU of EC80 control−mean RLU of vehicle control)). Data shown in FIG. 4 was normalized to the maximal and minimal response observed in the presence of EC80 ligand and vehicle respectively. The decrease in inhibition observed in FIG. 4, Panel A, is related to agonist activity and receptor selectivity of VIPR1. FIG. 4, Panel B, shows a percent inhibition of VIPR2 by Compound 8. Raw fluorescence data from the binding experiments performed in duplicate appears below in Table 6.

TABLE 6

VIP Analogue Antagonist Activity

| Compound ID 8 [Starting] 0.50 μM | | | Readout cAMP Mode Antagonist | |
|---|---|---|---|---|
| [Compound] (M) | Mean RLU | SD | % CV | % Inhibition |
| Cell Line VIPR1 | | | | |
| Basal Activity | 9923.0 | 846.5 | 8.5% | 130.0% |
| 5.00E−07 M | 124383.0 | 4497.2 | 3.8% | −30.5% |
| 1.00E−07 M | 123823.0 | 196.0 | 0.2% | −29.8% |
| 5.00E−08 M | 125168.0 | 2206.2 | 1.5% | −29.1% |
| 1.00E−08 M | 117123.0 | 1527.4 | 1.3% | −22.2% |
| 5.00E−09 M | 106743.0 | 2530.4 | 2.5% | −10.4% |
| 1.00E−09 M | 92543.0 | 2573.9 | 2.5% | 5.8% |
| 5.00E−10 M | 87923.0 | 0.0 | 0.0% | 11.1% |
| 1.00E−10 M | 90163.0 | 5317.4 | 5.9% | 8.5% |
| 1.00E−11 M | 88723.0 | 3234.4 | 3.6% | 10.2% |
| 1.00E−12 M | 92723.0 | 4468.9 | 4.8% | 5.6% |
| 0.00E+00 M | 97643.0 | 2149.6 | 2.2% | 0.0% |
| S/B | 9.8 | AvCV | 3.1% | |
| Cell Line VIPR2 | | | | |
| Basal Activity | 9303.0 | 196.0 | 2.1% | 130.0% |
| 5.00E−07 M | 64223.0 | 12377.4 | 14.3% | 8.4% |
| 1.00E−07 M | 79580.0 | 3705.2 | 4.7% | 6.5% |
| 5.00E−08 M | 79543.0 | 10534.9 | 13.3% | 6.2% |
| 1.00E−08 M | 77453.0 | 14566.4 | 18.8% | 9.4% |
| 5.00E−09 M | 76323.0 | 7371.1 | 9.3% | 10.9% |
| 1.00E−09 M | 79523.0 | 7495.3 | 9.4% | 6.5% |
| 5.00E−10 M | 74933.0 | 6081.1 | 8.1% | 12.7% |
| 1.00E−10 M | 81343.0 | 6081.1 | 7.5% | 4.2% |
| 1.00E−11 M | 78033.0 | 5518.5 | 8.5% | 8.7% |
| 1.00E−12 M | 81723.0 | 11144.0 | 13.5% | 3.7% |
| 0.00E+00 M | 84523.0 | 7523.5 | 8.9% | 0.0% |
| S/B | 9.1 | AvCV | 9.9% | |

In Vitro Binding Assay 2: The analogs of the present invention will be serially diluted into aqueous solutions with appropriate buffer. The various concentrations of analogs will be administered to a plurality of cells in culture that expresses relevant naturally occurring receptor family for the naturally occurring polypeptide upon which the analog is derived. In one method of detection, VPAC$_1$ CHO-K1 Division Arrested (DA) cells or VPAC$_1$-CRE-β-lactamase CHO-K1 cells (10,000 cells/well) are plated in a 384-well format and incubated for 16-20 hours. Cells can then be stimulated with a dilution series of each Secretin analog in the presence of 0.5% DMOS for 5 hours. Cells can then be loaded with an engineered fluorescent substrate containing two fluoroprobes, coumarin and fluorescein (2 uM final concentration if CCF4AM and 1 mM solution D) for two hours. In the absence of β-lactamase expression, the substrate molecule remains intact. In this state, excitation of the coumarin results in fluorescence resonance energy transfer to the fluorescein moiety and emission of green light (530 nm). However, in the presence of β-lactamase expression, the substrate is cleaved, thereby separating the fluorophores, and disrupting energy transfer. Excitation of the coumarin in the presence of enzyme β-lactamase activity results in a blue fluorescence signal (460 nm). Fluorescence emission values at 460 nm and 530 nm can be obtained using a standard fluorescence plate reader and plotted for each replicate against the concentration of analog present. The resulting blue:green ratio provides a normalized reporter response. The degree of β-lactamase expression is directly correlated to the stimulation of the specific receptor being interrogated. The particular receptor construct is covalently linked to a β-lactamase transcription factor, which is released upon receptor stimulation. Serially diluted analogs in the appropriate concentration of buffered solution (or medium alone as a control) will be added to individual wells together with cells expressing a specific receptor that is capable of β-lactamase production. A polypeptide that engages in competitive binding to the analog receptor, or medium only as a background control, will also be added to each well. After sufficient time, the wells will be inspected by light spectrometry to determine the relative light units, which serve a readout for receptor activation. Another mechanism for determining binding values is through the monitoring of a second messenger readout. For the intended receptor class, the detection of cAMP can be a direct indicator for receptor activation. Through the detection of cAMP (using known protocols) across a range of analog concentrations, the specific degree of receptor binding for each analog and concentration can be determined. The binding of the analog to receptor will be monitored by calculating the IC$_{50}$ values in media. The signal of test wells will be normalized to that of control wells without inhibitor after background subtraction from both. The percent inhibition of activity will be expressed as a function of the log 10 concentration of any competitive inhibitor added to the system. A four-parameter sigmoid function will be fitted to the data in Prism. The R$^2$ values for the fits will be determined. Finally, the means±S.E.M. of the IC$_{50}$ values from the individual fits of the three repeat experiments will be calculated.

In Vitro Binding Assay 3: The analogs of the present invention will be serially diluted into aqueous solutions with appropriate buffer. The various concentrations of analogs will be administered to a plurality of cells in culture that expresses relevant naturally occurring receptor family for the naturally occurring polypeptide upon which the analog is derived. The analogs will be administered to the cAMP Hunter™ eXpress CHO-K1 VIPR2 (DisocveRx) cells according to the manufacturers suggested protocol. cAMP Hunter™ Detection Reagents will be used to detect the concentration of analog bound on the surface of the cells as a function of signal strength in the absence and presence of wild-type VIP provided as a control. Various EC$_{50}$ values for the VIP analogs will be calculated per the manufacturer's recommended instructions.

In Vitro Selectivity Binding Assay: Binding assays: Membranes prepared from a stable VPAC2 cell line (such as a CHO-S cell line stably expressing human VPAC2 receptor or from cells transiently transfected with human VPAC1 or PAC1) are used. A filter binding assay is performed using $^{125}$I-labeled VIP for VPAC1 and VPAC2 and $^{125}$I-labeled PACAP-27 for PAC as the tracers. For this assay, the solutions and equipment include:

Presoak solution: 0.5% Polyethyleneamine in Aqua dest
Buffer for flushing filter plates: 25 mM HEPES pH 7.4
Blocking buffer: 25 mM HEPES pH 7.4; 0.2% protease free BSA
Assay buffer: 25 mM HEPES pH 7.4; 0.5% protease free BSA
Dilution and assay plate: PS-Microplate, U form
Filtration Plate Multiscreen FB Opaque Plate; 1.0 mM Type B Glasfiber filter In order to prepare the filter plates, the presoak solution will be aspirated by vacuum filtration. The plates will be flushed twice with 200 μL flush buffer. 200 μL blocking buffer will be added to the filter plate. The filter plate will then be incubated with 200 μL presoak solution for 1 hour at room temperature. The assay plate will be filled with 25 μL assay buffer, 25 μL membranes (2.5 μg) suspended in assay buffer, 25 μL agonist in assay buffer, and 25 μL tracer (about 40000 cpm) in assay buffer. The filled plate will be incubated for 1 hour with shaking. The transfer from assay plate to filter plate will be conducted. The blocking buffer will be aspirated by vacuum filtration and washed two times with flush buffer. 90 μL will be transferred from the assay plate to the filter plate. The 90 μL transferred from assay plate will be aspirated and washed three times with 200 μL flush buffer. The plastic support is removed. It is dried for 1 hour at 60° C. 30 μL Microscint will beadded. The count will be performed based upon analog affinity to VPAC1, VPAC2, or PAC1 receptors. $IC_{50}$ and $EC_{50}$ calculations will be performed based upon affinity scoring.

In Vivo Efficacy in Animal Models: To determine the activity of analogs of the invention in vivo as compared to the naturally occurring polypeptides upon which the analogs are derived, the analogs will be administered alone (IP, IV, SC, PO, by inhalation or nasal routes) or in combination with known active agent to monitor the above-mentioned disease states. Secretin family analogs alone or in combination with sub-optimal doses of relevant active agents for specific indications or disease states will be, for example, administered to an appropriate animal model mice (8-10 days after injection/day 1 of experiment) by tail vein or IP routes at doses ranging from 0.0001 mg/kg to 50 mg/kg for 1 to 21 days. Optionally, the mice will be assayed throughout the experiment with a selection marker relevant to the particular studies disease state every other day and survival monitored daily for the duration of the experiment. Expired mice will be optionally subjected to necropsy at the end of the experiment. These in vivo tests optionally generate preliminary pharmacokinetic, pharmacodynamic and toxicology data.

Adjuvant-Induced Arthritis in Rats: Adjuvant induced arthritis ("AIA") is an animal model useful in the study of rheumatoid arthritis ("RA"), which is induced by injecting *M. tuberculosis* in the base of the tail of Lewis rats. Between 10 and 15 days following injection, animals develop a severe, progressive arthritis.

Generally, analogs will be tested for their ability to alter hind paw swelling and bone damage resulting from adjuvant induced edema in rats. To quantitate the inhibition of hind paw swelling resulting from AIA, two phases of inflammation have been defined: (1) the primary and secondary injected hind paw, and (2) the secondary uninjected hind paw, which generally begins developing about eleven days from the induction of inflammation in the injected paw. Reduction of the latter type of inflammation is an indication of immunosuppressive activity. Cf. Chang, Arth. Rheum., 20, 1135-1141 (1977).

Using an animal model of RA, such as AIA, enables one to study the cellular events involved in the early stages of the disease. CD44 expression on macrophages and lymphocytes is up regulated during the early development of adjuvant arthritis, whereas LFA 1 expression is up regulated later in the development of the disease. Understanding the interactions between adhesion molecules and endothelium at the earliest stages of adjuvant arthritis could lead to significant advances in the methods used in the treatment of RA.

Collagen Induced Arthritis in Rats: To determine the efficacy of a representative analog of this invention administered by po bid dosing (Days (-1)-20) for inhibition of the inflammation, cartilage destruction and bone resorption that occurs in developing type II collagen arthritis in rats.

Animals: Female Lewis rats (Harlan), weighing 125-150 g on arrival. (inject subtotal of rats with collagen to get responders on days 10, 11, 12 for 6 groups of 10). The animals (a group for arthritis, a group for normal control), housed 4-5/cage, will be acclimated for 4-8 days. The animals will be dosed from about po 1 mg/kg bid to po 100 mg/kg bid.

Materials: Peptides or analogs in vehicle, Type II collagen, Freund's incomplete adjuvant, methotrexate (Sigma)

General Study Design: Dosing initiated on day minus 1. The acclimated animals will be anesthetized with isoflurane and given collagen injections (D0). On day 6 they will be anesthetized again for the second collagen injection. Collagen is prepared by making a 4 mg/mL solution in 0.01 N acetic acid. Equal volumes of collagen and Freund's incomplete adjuvant, will be emulsified by hand mixing until a bead of this material held its form when placed in water. Each animal will receive 300 uL of the mixture each time spread over 3 sites on back. Calipering of normal (pre-disease) right and left ankle joints are to be done approximately one ay prior to the expected days on onset of disease.

Rats will be weighed on days (-) 1, 6, 9, 10, 11, 12, 13, 14, 15, 16, 17, 18, 19, and 20 of the study and caliper measurements of ankles taken every day beginning on day 9. Final body weights will be taken on day 20. After final body weight measurement, animals are to be anesthetized for terminal plasma collection and then euthanization. Both hind paws and knees will be removed. Hind paws will be weighed, placed (with knees) in formalin and then processed for microscopy.

Processing of Joints: Following 1-2 days in fixative and then 4-5 days in decalcifier, the ankle joints will be cut in half longitudinally, knees will be cut in half in the frontal plane, processed, embedded, sectioned and stained with toluidine blue.

Induction of Colitis in HLA-B27 Rats: The efficacy of the analogs of the present invention in reversing colitis can be determined in HLA-B27 transgenic rats. HLA-B27 transgenic rats have been utilized as an animal model of Inflammatory Bowel Disease which mimics Crohn's Disease in humans. The rats overexpress the human MHC class I HLA-B27 heavy chain and beta-2 microglobulin proteins, which induces a variety of autoimmune diseases that include inflammation of the colon.

The therapeutic effect of the analogs described in this invention in terms of resolving colitis can be evaluated in HLA-B27 transgenic rats. Diseased rats will be dosed subcutaneously with 0.001-100 mg/kg of a single analog of this invention once or twice a day for 16 days or once per week for two weeks.

Disease Activity Index (DAI) scores will be used to determine the efficacy of each analog as compared to rats dosed with vehicle. In addition, fecal consistency and FOB scores for both rats dosed with analogs will be statistically compared to the vehicle group.

Induction of Colitis: 1-20 HLA-B27 (6-9 weeks old) transgenic rats will be acclimated in animal facility for 10 weeks. Animal bedding will be mixed from different cages once a week to control for a "dirty" environmental flora.

Treatments: Rats are to be enrolled and randomized into four groups (n=5) based on weight and DAI scores (FC.g-toreq.3, FOB.gtoreq.2). The experimental groups will be dosed subcutaneously with an analog 0.001-100 mg/kg once or twice a day for 16 days or once per week for two weeks and terminated at trough. The control groups include a vehicle-treated group and a GG5/3 (mouse anti-rat alpha-4 integrin antibody) positive control group dosed subcutaneously at 10 mg/kg (5 mL/kg) on d0, d3, and d6 and terminated at trough on d8. Fresh analog and vehicle treatments are to be formulated in advance of treatment.

Endpoint Read-outs: Disease Activity Index scores, Fecal Consistency test and Fecal Occult Blood test, are to be taken 4 times a week to generate in-life clinical scores. The primary read-out for the study is a histopathological analysis of cecum, proximal colon, mid-colon, and distal colon. An IBD scoring system was applied (Table H2). TABLE H2 IBD Scoring System Multiple Endpoints A Destruction of epithelium and glands B Dilatation of glandular crypts C Depletion and loss of goblet cells D Inflammatory cell infiltrates E Edema F Vascular congestion G Crypt Abscesses H Atrophia Primary Arterial Hypertension animal model: 36 adult male Sprague-Dawley rats (300-350 g in body weight were randomized for treatment 22 days after a s.c. injection of saline or 60 mg/kg MCT (Sigma-Aldrich) to induce pulmonary hypertension. In addition to a group of untreated rats, the experimental groups included rats that received either daily, weekly or monthly delivery of a secretin analog at an appropriate dose of (0.001-50 mg/kg or the delivery vehicle alone. On Day 22 a carotid/femoral artery will be accessed for arterial blood gases (systemic blood pressure can be monitored as well). Thoracotomy performed and right ventricle catheterized with a Millar catheter (or other appropriate catheter) which will be advanced to the pulmonary artery. Animals will have anesthesia induced and maintained on isoflurane through out the experiment. Rats will be intubated prior to surgical procedures. Hemodynamic measurements such as Pulmonary arterial pressure, systemic blood pressure (SAP, DAP, MAP) and heart rate are to be collected continuously via a Gould-Ponemah physiograph. Statistical analysis will be performed on all hemodynamic data. Arterial blood samples collected at protocol specified time points (up to 8 time points) for analysis of drug concentration and/or arterial blood gases. Animals euthanized after 30 minutes and lungs collected and snap frozen for shipment to the Sponsor. Lungs analyzed for levels of drug. Animals are to be clinically observed once daily with body weight measured weekly. While some embodiments of the invention have been illustrated and described, it will be appreciated that various changes can be made therein without departing from the spirit and scope of the invention.

Small Cell Lung Cancer Model: Female athymic BAL-Byc nude mice, 4-5 weeks old, will be housed in filter-top cages in a pathogen free, temperature-controlled, laminar-flow, filtered-air, isolated room and will be exposed to light from 7:00 a.m. to 7:00 p.m. NCI-H69 cells will be injected subcutaneously into the right flank of each mouse. There were four experimental groups, of four mice each, three of which will receive VIP and/or an analog of VIP (1.0, 5.0, or 10 mg/day) in PBS; as a control, the fourth will receive only PBS. All solutions will be infused for 8 weeks, beginning 1 week after injection of the cells, and delivered by i.v., i.p., subc., i.m. injection or osmotic pumps placed aseptically under the skin of the back of the mice. The pump will release its contents at a rate of 0.5 ml/h for a duration of 2 weeks. The spent pumps will be removed every 2 weeks, and new pumps, containing fresh solutions, will be implanted with known techniques; this procedure will be repeated three times. After treatment, The tumors will be measured with calipers, and the mice will be weighed weekly for 8 weeks. Tumor volume will be calculated for an ellipsoid as (maximal length)×(maximal height)×(maximal width)×($\pi/6$). On the last day of the experiment, blood will be sampled from the retroorbital plexus into chilled heparin-containing tubes rinsed with 0.05% NaEDTA and containing three protease inhibitors, 10 mg/ml soybean trypsin inhibitor, 100 TIU/ml aprotinin, and 10 mg/ml phosphamidon), as well as 0.1 mM IBMX for measurement of plasma VIP and cAMP levels. The mice will then euthanized. The tumors will be excised, weighed, and frozen in liquid nitrogen for subsequent extraction (in methanol) and for measurement of protein content by known techniques; a portion of the tumor will be fixed in 10% neutral buffered formalin for morphologic examination.

One purpose of these studies is to evidence that the analogs are capable of producing the desired biological, biochemical, diagnostic, medicinal and/or therapeutic outcome in a living animal.

Example 5

DPPIV Protease Assay (Prophetic)

Digest buffer {100 mM Tris-HCl (pH 8)} containing 15 µM peptide and 1 µg porcine kidney DPPIV (Sigma-Aldrich) will be incubated at 37 C. The reaction will be terminated at the specified time point by adding 10 µl 10% TFA, followed by reverse-phase HPLC on a Gemini C18 column (Phenomenex, Macclesfield, UK). The column will be eluted with a linear gradient of 27-31% AcN over 50 min at 1 ml/min. Peptides and their degradation products will be monitored by their absorbance at 214 nm. Percent degradation will be quantified by integration of peak areas related to undigested peptide peaks and corrected for degradation in the absence of enzyme.

Example 6

Method for Measuring Triglyceride Levels hApoA1 mice (obtained from Jackson Laboratories, Bar Harbor, Me.) are bled (by either eye or tail vein) and grouped according to equivalent mean serum triglyceride levels. They are dosed orally (by gavage in a pharmaceutically acceptable vehicle) with the test polypeptide once daily for 8 days. The animals are then bled again by eye or tail vein, and serum triglyceride levels are determined. In each case, triglyceride levels are measured using a Technicon Axon Autoanalyzer (Bayer Corporation, Tarrytown, N.Y.).

Method for Measuring HDL-Cholesterol Levels

To determine plasma HDL-cholesteral levels, hApoA1 mice are bled and grouped with equivalent mean plasma HDL-cholesterol levels. The mice are orally dosed once daily with vehicle or test polypeptide for 7 days, and then bled again on day 8. Plasma is analyzed for HDL-cholesterol using the Synchron Clinical System (CX4) (Beckman Coulter, Fullerton, Calif.).

Method for Measuring Total Cholesterol, HDL-Cholesterol, Triglycerides, and Glucose Levels. In another in vivo assay, obese monkeys are bled, then orally dosed once daily with vehicle or test polypeptide for 4 weeks, and then bled again. Serum is analyzed for total cholesterol, HDL-cholesterol, triglycerides, and glucose using the Synchron Clinical System (CX4) (Beckman Coulter, Fullerton, Calif.). Lipoprotein subclass analysis is performed by NMR spectroscopy as described by Oliver, et al., (Proc. Natl. Aced. Sci. USA 98:5306-5311, 2001).

The following journal articles, which are herein incorporated by reference, disclose secretin family analogs contemplated to be a polypeptide backbone for the secretin family analogs of the invention. The journal articles also disclose a series of methods of administering secretin family analogs as part of pharmaceutical compositions:

1. Gozes, et. al., *Current Pharmaceutical Design*, 2003, Vol. 9, No. 6
2. Delgado, et. al., *Brain Behav Immun.* 2008 November; 22(8): 1146-1151. doi:10.1016/j.bbi.2008.06.001.
3. L. Dickson, K. Finlayson/*Pharmacology & Therapeutics* 121 (2009) 294-316.
4. Gonzales-Rey, et. al., *TRENDS in Pharmacological Sciences* Vol. 28 No. 9.
5. Varela, et. al., *Expert Opin. Biol. Ther.* (2007) 7(4):461-478
6. Brenneman, Peptides 28 (2007) 1720-1726;
7. Onoue, et. al., Naunyn-Schmiedeberg's *Arch Pharmacol* (2008) 377:579-590

Any journal article, patent application, issued patent or other publication referenced in this application is herein incorporated by reference. The embodiments listed herein are not meant to be restrictive, but rather illustrative of the invention.

SEQUENCE LISTING (1379 sequences)

SEQ ID NO: 1 - protein, 44 aa, homo sapiens
YADAIFTNSYRKVLGQLSARKLLQDIMSRQQGESNQERGARARL

SEQ ID NO: 2 - protein, 42 aa, homo sapiens
YAEGTFISDYSIAMDKIHQQDFVNWLLAQKGKKNDWKHNITQ

SEQ ID NO: 3 - protein, 37 aa, homo sapiens
HDEFERHAEGTFTSDVSSYLEGQAAQGFIAWLVKGRG

SEQ ID NO: 4 - protein, 29 aa, homo sapiens
HSQGTFTSDYSKYLDSRRAQDFVQWLMNT

SEQ ID NO: 5 - protein, 27 aa, homo sapiens
HSDGIFTDSYSRYRKQMAVKKYLAAVL

SEQ ID NO: 6 - protein, 38 aa, homo sapiens
HSDGIFTDSYSRYRKQMAVKKYLAAVLGKRYKQRVKNK

SEQ ID NO: 7 - protein, 27 aa, homo sapiens
HADGVFTSDFSKLLGQLSAKKYLESLM

SEQ ID NO: 8 - protein, 29 aa, homo sapiens
DVAHGILNEAYRKVLGQLSAGKHLQSLVA

SEQ ID NO: 9 - protein, 27 aa, homo sapiens
HSDGTFTSELSRLREGARLQRLLQGLV

SEQ ID NO: 10 - protein, 28 aa, homo sapiens
HSDAVFTDNYTRLRKQMAVKKYLNSILN

SEQ ID NO: 11 - protein, 178 aa, homo sapiens
MHSSALLCCLVLLTGVRASPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCHRFLPCENKSKAVEQVKNAFNKLQEKGIYKAMSEFDIFINYIEAYMTMKIRN

SEQ ID NO: 12 - protein, 153 aa, homo sapiens [sequence omitted]

SEQ ID NO: 13 - protein, 135 aa, homo sapiens
MGLTSQLLPPLFFLLACAGNFVHGHKCDITLQEIIKTLNSLTEQKNTTEKETFCRAATVLRQFYSHHEKDTRCLGATAQQFHRHKQLIRFLKRLDRNLWGLAGLNSCPVKEANQSTLENFLERLKMREKYSKCSS

SEQ ID NO: 14 - protein, 134 aa, homo sapiens
MRMLLHLSLLALGAAYVYAIPTEIPTSALVKETLALLSTHRTLLIANETLRIPVPVHKNHQLCTEEIFQGIGTLESQTVQGGTVERLFKNLSLIKKYIDGQKKKCGEERRRVNQFLDYLQEFLGVMNTEWIIES

SEQ ID NO: 15 - protein, 70 aa, homo sapiens
MTSKLAVALLAAFLISAALCEGAVLPRSAKELRCQCIKTYSKPFHPKFIKELRVIESGPHCANTEIIVKL

SEQ ID NO: 16 - protein, 29 aa, homo sapiens
SDGRELCLDPKENWVQRVVEKFLKRAENS

SEQ ID NO: 17 - protein, 253 aa, homo sapiens
MWPPGSASQPPPSPAAATGLHPAARPVSLQCRLSMCPARSLLLVATLVLLDHLSLARNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNAS

SEQ ID NO: 18 - protein, 328 aa, homo sapiens
MCHQQLVISWFSLVFLASPLVAIWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCS

SEQ ID NO: 19 - protein, 153 aa, homo sapiens
MYRMQLLSCIALSLALVTNSAPTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFCQSIISTLT

SEQ ID NO: 20 - protein, 162 aa, homo sapiens
MRISKPHLRSISIQCYLCLLLNSHFLTEAGIHVFILGCFSAGLPKTEANWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTS

SEQ ID NO: 21 - protein, 155 aa, homo sapiens
MTPGKTSLVSLLLLLSLEAIVKAGITIPRNPGCPNSEDKNFPRTVMVNLNIHNRNTNTNPKRSSDYYNRSTSPWNLHRNEDPERYPSVIWEAKCRHLGCINADGNVDYHMNSVPIQQEILVLRREPPHCPNSFRLEKILVSVGCTCVTPIVHHVA

SEQ ID NO: 22 - protein, 193 aa, homo sapiens
MAAEPVEDNCINFVAMKFIDNTLYFIAEDDENLESDYFGKLESKLSVIRNLNDQVLFIDQGNRPLFEDMTDSDCRDNAPRTIFIISMYKDSQPRGMAVTISVKCEKISTLSCENKIISFKEMNPPDNIKDTKSDIIFFQRSVPGHDNKMQFESSSYEGYFLACEKERDLFKLILKKEDELGDRSIMFTVQNED

SEQ ID NO: 23 - protein, 193 aa, homo sapiens
MTMRHNWTPDLSPLWVLLLCAHVVTLLVRATPVSQTTTAATASVRSTKDPCPSQPPVFPAAKQCPALEVTWPEVEVPLNGTLSLSCVACSRFPNFSILYWLGNGSFIEHLPGRLWEGSTSRERGSTGTQLCKALVLEQLTPALHSTNFSCVLVDPEQVVQRHVVLAQLWAGLRATLPPTQEALPSSHSSPQQQ

SEQ ID NO: 24 - protein, 162 aa, homo sapiens
MRSSPGNMERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 25 - protein, 179 aa, homo sapiens
MAALQKSVSSFLMGTLATSCLLLLALLVQGGAAAPISSHCRLDKSNFQQPYITNRTFMLAKEASLADNNTDVRLIGEKLFHGVSMSERCYLMKQVLNFTLEEVLFPQSDRFQPYMQEVVPFLARLSNRLSTCHIEGDDLHIQRNVQKLKDTVKKLGESGEIKAIGELDLLFMSLRNACI

SEQ ID NO: 26 - protein, 206 aa, homo sapiens
MNFQQRLQSLWTLARPFCPPLLATASQMQMVVLPCLGFTLLLWSQVSGAQGQEFHFGPCQVKGVVPQKLWEAFWAVKDTMQAQDNITSARLLQQEVLQNVSDAESCYLVHTLLEFYLKTVFKNYHNRTVEVRTLKSFSTLANNFVLIVSQLQPSQENEMFSIRDSAHRRFLLFRRAFKQLDVEAALTKALGEVDILLTWMQKFYKL

SEQ ID NO: 27 - protein, 48 aa, homo sapiens
MFSIRDSAHRRFLLFRRAFKQLDVEAALTKALGEVDILLTWMQKFYKL

SEQ ID NO: 28 - protein, 171 aa, homo sapiens
MLVNFILRCGLLLVTLSLAIAKHKQSSFTKSCYPRGTLSQAVDALYIKAAWLKATIPEDRIKNIRLLKKKTKKQFMKNCQFQEQLLSFFMEDVFGQLQLQGCKKIRFVEDFHSLRQKLSHCISCASSAREMKSITRMKRIFYRIGNKGIYKAISELDILLSWIKKLLESSQ

SEQ ID NO: 29 - protein, 267 aa, homo sapiens
MPRSCCSRSGALLLALLLQASMEVRGWCLESSQCQDLTTESNLLECIRACKPDLSAETPMFPGNGDEQPLTENPRKYVMGHFRWDRFGRRNSSSSGSSGAGQKREDVSAGEDCGPLPEGGPEPRSDGAKPGPREGKRSYSMEHFRWGKPVGKKRRPVKVYPNGAEDESAEAFPLEFKRELTGQRLREGDGPDGPADDGAGAQADLEHSLLVAAEKKDEGPYRMEHFRWGSPPKDKRYGGFMTSEKSQTPLVTLFKNAIIKNAYKKGE

SEQ ID NO: 30 - protein, 113 aa, homo sapiens
MRQAGRAALLAALLLLVQLCPGSSQRSPEAAGVQDPSLRWSPGARNQGGGARALLLLLAERFPRRAGPGRLGLGTAGERPRRDNPSLSIDLTFHLLRTLLELARTQSQRERAE

SEQ ID NO: 31 - protein, 112 aa, homo sapiens
MTRCALLLLMVLMLGRVLVVPVTPIPTFQLRPQNSPQTTPRPAASESPSAAPTWPWAAQSHCSPTRHPGSRIVLSLDVPIGLLQILLEQARARAAREQATTNARILARVGHC

SEQ ID NO: 32 - protein, 161 aa, homo sapiens
MLMPVHFLLLLLLLLGGPRTGLPHKFYKAKPIFSCLNTALSEAEKGQWEDASLLSKRSFHYLRSRDASSGEEEEGKEKKTFPISGARGGARGTRYRYVSQAQPRGKPRQDTAKSPHRTKFTLSLDVPTNIMNLLFNIAKAKNLRAQAAANAHLMAQIGRKK

SEQ ID NO: 33 - protein, 185 aa, homo sapiens
MKLVSVALMYLGSLAFLGADTARLDVASEFRKKWNKWALSRGKRELRMSSSYPTGLADVKAGPAQTLIRPQDMKGASRSPEDSSPDAARIRVKRYRQSMNNFQGLRSFGCRFGTCTVQKLAHQIYQFTDKDKDNVAPRSKISPQGYGRRRRRSLPEAGPGRTLVSSKPQAHGAPAPPSGSAPHFL

SEQ ID NO: 34 - protein, 155 aa, homo sapiens
MYRHKNSWRLGLKYPPSSKEETQVPKTLISGLPGRKSSSRVGEKLQSAHKMPLSPGLLLLLLSGATATAALPLEGGPTGRDSEHMQEAAGIRKSSLLTFLAWWFEWTSQASAGPLIGEEAREVARRQEGAPPQQSARRDRMPCRNFFWKTFSSCK

SEQ ID NO: 35 - protein, 116 aa, homo sapiens
MLSCRLQCALAALSIVLALGCVTGAPSDPRLRQFLQKSLAAAAGKQELAKYFLAELLSEPNQTENDALEPEDLSQAAEQDEMRLELQRSANSNPAMAPRERKAGCKNFFWKTFTSC

SEQ ID NO: 36 - protein, 117 aa, homo sapiens
MPSPGTVCSLLLLGMLWLDLAMAGSSFLSPEHQRVQQRKESKKPPAKLQPRALAGWLRPEDGGQAEGAEDELEVRFNAPFDVGIKLSGVQYQQHSQALGKFLQDILWEEAKEAPADK

SEQ ID NO: 37 - protein, 116 aa, homo sapiens
MPSPGTVCSLLLLGMLWLDLAMAGSSFLSPEHQRVQRKESKKPPAKLQPRALAGWLRPEDGGQAEGAEDELEVRFNAPFDVGIKLSGVQYQQHSQALGKFLQDILWEEAKEAPADK

SEQ ID NO: 38 - protein, 105 aa, homo sapiens
MFTCWWSYLRSTLAAVPGEASRVQQRKESKKPPAKLQPRALAGWLRPEDGGQAEGAEDELEVRFNAPFDVGIKLSGVQYQQHSQALGKFLQDILWEEAKEAPADK

SEQ ID NO: 39 - protein, 104 aa, homo sapiens
MFTCWWSYLRSTLAAVPGEASRVQRKESKKPPAKLQPRALAGWLRPEDGGQAEGAEDELEVRFNAPFDVGIKLSGVQYQQHSQALGKFLQDILWEEAKEAPADK

SEQ ID NO: 40 - protein, 66 aa, homo sapiens
MFTCWWSYLRSTLAAVPGEASRVQFNAPFDVGIKLSGVQYQQHSQALGKFLQDILWEEAKEAPADK

SEQ ID NO: 41 - protein, 36 aa, homo sapiens
MPSPGTVCSLLLLGMLWLDLAMAGSSFLSPEHQRVQ

SEQ ID NO: 42 - protein, 9 aa, Aplysia californica
APRLRFYSL

SEQ ID NO: 43 - protein, 5 aa, Mus musculus
RLRFD

SEQ ID NO: 44 - protein, 5 aa, Artificial Sequence
  beta - Bag Cell Peptide
RLRFH

SEQ ID NO: 45 - protein, 25 aa, Artificial Sequence
  BAM (Bovine Adrenal Medulla) 3200 Peptide E
YGGFMRRVGRPEWWMDYQKRYGGFL

SEQ ID NO: 46 - protein, 18 aa, Artificial Sequence
  BAM (Bovine Adrenal Medulla) 18P
YGGFMRRVGRPEWWMDYQ

SEQ ID NO: 47 - protein, 12 aa, Artificial Sequence
  BAM - 12P  Bovine Adrenal Medulla Docosapeptide
YGGFMRRVGRPE

SEQ ID NO: 48 - protein, 6 aa, Artificial Sequence
  BAM - 12P  Bovine Adrenal Medulla Docosapeptide (7 - 12)
RVGRPE

SEQ ID NO: 49 - protein, 8 aa, Artificial Sequence
  bFGF (119 - 126)  Basic Fibroblast Growth Factor  human  bovine
KRTGQYKL

SEQ ID NO: 50 - protein, 8 aa, Artificial Sequence
  bFGF Inhibitory Peptide
APSGHYKG

SEQ ID NO: 51 - protein, 16 aa, Artificial Sequence
  bFGF Inhibitory Peptide II
MWYRPDLDERKQQKRE

SEQ ID NO: 52 - protein, 20 aa, Artificial Sequence
  Bax BH3 peptide, Glu63 mutant
STKKLSECEKRIGDELDSNM

SEQ ID NO: 53 - protein, 24 aa, homo sapiens
NLWAAQRYGRELRRMSDEFVDSFK

SEQ ID NO: 54 - protein, 25 aa, homo sapiens
NLWAAQRYGRELRRMSDEFVDSFKK

SEQ ID NO: 55 - protein, 17 aa, Artificial Sequence
  BAD peptide (NT - 1)
  MOD_RES (17)..(17): AMIDATION
PEFEPSEQEDSSSAERC

SEQ ID NO: 56 - protein, 17 aa, Artificial Sequence
  Bak BH3 peptide, TAMRA labeled
  MOD_RES (17)..(17): AMIDATION
GQVGRQLAIIGDDINRK

SEQ ID NO: 57 - protein, 20 aa, homo sapiens
STKKLSECLKRIGDELDSNM

SEQ ID NO: 58 - protein, 45 aa, Artificial Sequence
  Bcl 9-2 peptide
  MOD_RES (45)..(45): AMIDATION
GSEGLSKEQLEHRERSLQTLRDIERLLLRSGETEPFLKGPPGGAG

SEQ ID NO: 59 - protein, 25 aa, Artificial Sequence
  BMf - BH3 peptide
LQHRAEVQIARKLQCIADQFHRLHT

SEQ ID NO: 60 - protein, 26 aa, Artificial Sequence
  Noxa BH3  Peptide 1
PAELEVECATQLRRFGDKLNFRQKLL

SEQ ID NO: 61 - protein, 14 aa, Artificial Sequence
  Bombesin {D - Phe12  Leu14}
  MISC_FEATURE (1)..(1): Xaa = Pyroglutamic acid
  MISC_FEATURE (12)..(12): Xaa = d-Phenylalanine
  MOD_RES (14)..(14): AMIDATION
XQRLGNQWAVGXLL

SEQ ID NO: 62 - protein, 14 aa, Artificial Sequence
  Bombesin 2, synthesized
  MISC_FEATURE (1)..(1): Xaa = Pyroglutamic acid
  MISC_FEATURE (12)..(12): Xaa = d-Phenylalanine
  MOD_RES (14)..(14): AMIDATION
XQRLGNQWAVGXLM

SEQ ID NO: 63 - protein, 9 aa, Artificial Sequence
  Bombesin {D - Tyr6  beta - Ala11  Phe13  Nle14}
  MISC_FEATURE (1)..(1): Xaa = d-Tyrosine
  MISC_FEATURE (6)..(6): Xaa = beta Alaine
  MOD_RES (9)..(9): AMIDATION
  MISC_FEATURE (9)..(9): Xaa = Noraleucine
XQWAVXHFX

SEQ ID NO: 64 - protein, 13 aa, Artificial Sequence
  Bombesin {D - Tyr6 beta - Ala11 b - Phe13 Nle14}
  MISC_FEATURE (5)..(5): Xaa = d-Tyrosine
  MISC_FEATURE (10)..(10): Xaa = beta Alaine
  MISC_FEATURE (12)..(12): Xaa = beta Phenylalaine
  MOD_RES (13)..(13): AMIDATION
  MISC_FEATURE (13)..(13): Xaa = Noraleucine
QRLGXQWAVXHXX

SEQ ID NO: 65 - protein, 14 aa, Artificial Sequence
  {Lys3} - Bombesin 3
  MISC_FEATURE (1)..(1): Xaa = Pyroglutamic acid
  MOD_RES (14)..(14): AMIDATION
XQKLGNQWAVGHLM

SEQ ID NO: 66 - protein, 14 aa, Artificial Sequence
  Bombesin {Tyr4 D - Phe12}
  MISC_FEATURE (1)..(1): Xaa = Pyroglutamic acid
  MISC_FEATURE (12)..(12): Xaa = d-Phenylalanine
  MOD_RES (14)..(14): AMIDATION
XQRYGNQWAVGXLM

SEQ ID NO: 67 - protein, 14 aa, Artificial Sequence
  Bombesin 1
  MOD_RES (14)..(14): AMIDATION
EQRLGNQWAVGHLM

SEQ ID NO: 68 - protein, 14 aa, Artificial Sequence
  Bombesin 2
  MISC_FEATURE (1)..(1): Xaa = Pyroglutamic acid
  MOD_RES (14)..(14): AMIDATION
XQRLGNQWAVGHLM

SEQ ID NO: 69 - protein, 9 aa, Artificial Sequence
  Bradykinin {D - Phe7}
  MISC_FEATURE (7)..(7): Xaa = d-Phenylalanine
RPPGFSXFR

SEQ ID NO: 70 - protein, 9 aa, Artificial Sequence
  Bradykinin {Des - Arg1}
  MISC_FEATURE (1)..(1): Xaa = des-Arginine
XPPGFSPFR

SEQ ID NO: 71 - protein, 11 aa, Rattus norvegicus
ISRPPGFSPFR

SEQ ID NO: 72 - protein, 9 aa, Artificial Sequence
  Bradykinin {Leu8  Des - Arg9}
  MISC_FEATURE (9)..(9): Xaa = des-Arginine
RPPGFSPLX

SEQ ID NO: 73 - protein, 10 aa, homo sapiens
KRPPGFSPFR

SEQ ID NO: 74 - protein, 9 aa, Artificial Sequence
  Angiotensin Converting Enzyme Inhibitor  BPP 9a
  MISC_FEATURE (1)..(1): Xaa = Pyroglutamic acid
XWPRPQIPP

SEQ ID NO: 75 - protein, 9 aa, Ascaphus truei
RPPGFSPFR

SEQ ID NO: 76 - protein, 9 aa, Ascaphus truei
RPPGFSPFR

SEQ ID NO: 77 - protein, 10 aa, Artificial Sequence
  Bradykinin Potentiator B  Angiotensin I Converting Enzyme Inhibitor
GLPPRPKIPP

SEQ ID NO: 78 - protein, 10 aa, Artificial Sequence
  Bradykinin Potentiator C  Angiotensin I Converting Enzyme Inhibitor
GLPPGPPIPP

SEQ ID NO: 79 - protein, 9 aa, Artificial Sequence
  Hemopressin
PVNFKLLSH

SEQ ID NO: 80 - protein, 31 aa, homo sapiens
EAEDLQVGQVELGGGPGAGSLQPLALEGSLQ

SEQ ID NO: 81 - protein, 35 aa, Artificial Sequence
  Proinsulin C - peptide (55 - 89)
RREAEDLQVGQVELGGGPGAGSLQPLALEGSLQKR

SEQ ID NO: 82 - protein, 15 aa, Artificial Sequence
  Fragment {Trp63  64} - C3a (63 - 77), synthesized
WWGKKYRASKLGLAR

SEQ ID NO: 83 - protein, 8 aa, Artificial Sequence
  Fragment C3a (70 - 77), synthesized
ASHLGLAR

SEQ ID NO: 84 - protein, 12 aa, Artificial Sequence
  Fragment C3f of Human c3 (1286 - 1297), synthesized
THRIHWESASLL

SEQ ID NO: 85 - protein, 17 aa, homo sapiens
SSKITHRIHWESASLLR

SEQ ID NO: 86 - protein, 17 aa, Artificial Sequence
  Fragment Complement anaphylatoxin C5a (37 - 53), synthesized
RAARISLGPRCIKAFTE

SEQ ID NO: 87 - protein, 19 aa, Artificial Sequence
  Fragment - CGRP (19 - 37), synthesized
  MOD_RES (19)..(19): AMIDATION
SGGVVKNNFVPTNVGSKAF

SEQ ID NO: 88 - protein, 38 aa, Artificial Sequence
  Fragment - CGRP Calcitonin Gene Related Peptide {Tyr0}, synthesized
  DISULFID (3)..(8): Disulfide Bond
  MOD_RES (38)..(38): AMIDATION
YACDTATCVTHRLAGLLSRSGGVVKNNFVPTNVGSKAF

SEQ ID NO: 89 - protein, 32 aa, Artificial Sequence
  Fragment Calcitonin
  DISULFID (1)..(7): Disulfide Bond
  MOD_RES (32)..(32): AMIDATION
CGNLSTCMLGTYTQDFNKFHTFPQTAIGVGAP

SEQ ID NO: 90 - protein, 30 aa, Artificial Sequence
  Human Calcitonin Gene Related Peptide  CGRP (8 - 37), synthesized
  MOD_RES (30)..(30): AMIDATION
VTHRLAGLLSRSGGVVKNNFVPTNVGSKAF

SEQ ID NO: 91 - protein, 30 aa, Artificial Sequence
  Rat Calcitonin Gene Related Peptide  CGRP (8 - 37), synthesized
  MOD_RES (30)..(30): AMIDATION
VTHRLAGLLSRSGGVVKDNFVPTNVGSEAF

SEQ ID NO: 92 - protein, 35 aa, Artificial Sequence
  Chicken Calcitonin Gene Related Peptide  CGRP, synthesized
  MOD_RES (1)..(1): ACETYLATION
  DISULFID (2)..(7): Disulfide Bond
  MOD_RES (35)..(35): AMIDATION
NTATCVTHRLADFLSRSGGVGKNNFVPTNVGSKAF

SEQ ID NO: 93 - protein, 35 aa, homo sapiens
  MOD_RES (1)..(1): ACETYLATION
  DISULFID (2)..(7): Disulfide Bond
  MOD_RES (35)..(35): AMIDATION
DTATCVTHRLAGLLSRSGGVVKNNFVPTNVGSKAF

SEQ ID NO: 94 - protein, 57 aa, Artificial Sequence
  Calcitonin N - Terminal Flanking Peptide N - Procalcitonin
APFRSALESSPADPATLSEDEARLLLAALVQDYVQMKASELEQEQEREGSSLDSPRS

SEQ ID NO: 95 - protein, 32 aa, Gallus gallus
  MOD_RES (32)..(32): AMIDATION
CASLSTCVLGKLSQELHKLQTYPRTDVGAGTP

SEQ ID NO: 96 - protein, 32 aa, Anguilla japonica
  DISULFID (1)..(7): Disulfide Bond
  MOD_RES (32)..(32): AMIDATION
CSNLSTCVLGKLSQELHKLQTYPRTDVGAGTP

SEQ ID NO: 97 - protein, 32 aa, Artificial Sequence; identical to SEQ ID NO: 89
  Calcitonin 2, synthesized
  DISULFID (1)..(7): Disulfide Bond
  MOD_RES (32)..(32): AMIDATION

SEQ ID NO: 98 - protein, 32 aa, Sus scrofa
  DISULFID (1)..(7): Disulfide Bond
  MOD_RES (32)..(32): AMIDATION
CSNLSTCVLSAYWRNLNNFHRFSGMGFGPETP

SEQ ID NO: 99 - protein, 32 aa, Rattus norvegicus
  DISULFID (1)..(7): Disulfide Bond
  MOD_RES (32)..(32): AMIDATION
CGNLSTCMLGTYTQDLNKFHTFPQTSIGVGAP

SEQ ID NO: 100 - protein, 32 aa, Oncorhynchus gorbuscha
  DISULFID (1)..(7): Disulfide Bond
  MOD_RES (32)..(32): AMIDATION
CSNLSTCVLGKLSQELHKLQTYPRTNTGSGTP

SEQ ID NO: 101 - protein, 33 aa, Artificial Sequence
  Calcitonin - Lys
  DISULFID (1)..(7): Disulfide Bond
CGNLSTCMLGTYTQDFNKFHTFPQTAIGVGAPK

SEQ ID NO: 102 - protein, 33 aa, Artificial Sequence; identical to SEQ ID NO: 101
  Calcitonin - Lys

SEQ ID NO: 103 - protein, 11 aa, Artificial Sequence
  Fragment { - 2}pPSA Prostate
SRIVGGWECEK

SEQ ID NO: 104 - protein, 13 aa, Artificial Sequence
  Fragment{ - 4}pPSA
ILSRIVGGWECEK

SEQ ID NO: 105 - protein, 24 aa, Artificial Sequence
  Fragment {A90 95} Bid BH3 (77 - 100)
ESQEEIIHNIARHAAQIGAEMDHN

SEQ ID NO: 106 - protein, 16 aa, Artificial Sequence
  Fragment {Ala6  Val15} MUC5AC Analog 2
GTTPSAVPTTSTTSVP

SEQ ID NO: 107 - protein, 16 aa, Artificial Sequence
  Fragment {APLILSR}pPSA
APLILSRIVGGWECEK

SEQ ID NO: 108 - protein, 34 aa, Artificial Sequence
  Fragment {Arg67}Bax H2 - H3 (53 - 86)  {R67} Helix 2 - 3 (53 - 86)
DASTKKLSECLKRIRDELDSNMELQRMIAAVDTD

SEQ ID NO: 109 - protein, 9 aa, Artificial Sequence
  Fragment {Asn370} tyrosinase (368 - 376)
YMNGTMSQV

SEQ ID NO: 110 - protein, 9 aa, Artificial Sequence
  Fragment {Asp370} - Tyrosinase (368 - 376)
YMDGTMSQV

SEQ ID NO: 111 - protein, 44 aa, Artificial Sequence
  Fragment {Cys(Acm)33} - Endostatin (6 - 49)
FQPVLHLVALNSPLSGGMRGIRGADFQCFQQARAVGLAGTFRAF

SEQ ID NO: 112 - protein, 16 aa, Artificial Sequence
  Fragment {Gln340} - Maspin  Reactive Site Loop (RSL)  (330 - 345)
GGDSIEVPGAQILQHK

SEQ ID NO: 113 - protein, 16 aa, Artificial Sequence
  Fragment {Ile12  Val15} MUC5AC Analog 3
GTTPSPVPTTSITSVP

SEQ ID NO: 114 - protein, 10 aa, Artificial Sequence
  Fragment {Ile161}MAGE - A2 (157 - 166)
YLQLIFGIEV

SEQ ID NO: 115 - protein, 14 aa, Artificial Sequence
  Fragment {pSer155} - BAD BH3 (146 - 159)
  MISC_FEATURE (10)..(10): Xaa = phosphorolyated Serine
RYGRELRRMXDEFE

SEQ ID NO: 116 - protein, 8 aa, Artificial Sequence
  Fragment {pThr145} - p21 (140 - 147), synthesized
  MISC_FEATURE (6)..(6): Xaa = phosphorolyatd Threonine
RKRRQXSM

SEQ ID NO: 117 - protein, 12 aa, Artificial Sequence
  Fragment {Ser244} Tyrosinase (240 - 251), synthesized
DAEKSDICTDEY

SEQ ID NO: 118 - protein, 9 aa, Artificial Sequence
  Fragment {Val165}NY - ESO - 1(157 - 165), synthesized
SLLMWITQV

SEQ ID NO: 119 - protein, 9 aa, Artificial Sequence
  Fragment 234 CM, synthesized
KYICNSSCM

SEQ ID NO: 120 - protein, 9 aa, Artificial Sequence
  Fragment 234 CW, synthesized
KYMCNSSCM

SEQ ID NO: 121 - protein, 9 aa, Artificial Sequence
  Fragment 53BP2 (490 - 498)  p53 - Binding Loop (CDB3), synthesized
REDEDEIEW

SEQ ID NO: 122 - protein, 9 aa, Artificial Sequence
  Fragment Adipophilin, synthesized
SVASTITGV

SEQ ID NO: 123 - protein, 34 aa, Artificial Sequence
  Fragment Amphoterin (150 - 183), synthesized
KLKEKYEKDIAAYRAKGKPDAAKKGVVKAEKSKK

SEQ ID NO: 124 - protein, 35 aa, Artificial Sequence
  Antennapedia Bak BH3 (Ant - BH3) (71 - 89), synthesized
RQIKIWFQNRRMKWKKMGQVGRQLAIIGDDINRRY

SEQ ID NO: 125 - protein, 4 aa, Artificial Sequence
  Bad (103 - 127), synthesized
  MISC_FEATURE (1)..(1): Xaa = D - Alanine
  MISC_FEATURE (2)..(2): Xaa = D - Alanine
  MISC_FEATURE (3)..(3): Xaa = D - Alanine
  MISC_FEATURE (4)..(4): Xaa = D - Alanine
XXXX

SEQ ID NO: 126 - protein, 24 aa, Artificial Sequence
  BAD Peptide (CT - 1), synthesized
  MOD_RES (24)..(24): AMIDATION
KKGLPRPKSAGTATQMRQSSSWTC

SEQ ID NO: 127 - protein, 21 aa, Artificial Sequence
  BAD BH3 Peptide (103 - 123), synthesized
NLWAAQRYGRELRRMSDEFVD

SEQ ID NO: 128 - protein, 14 aa, Artificial Sequence
  BAD BH3 Peptide (146 - 159), synthesized
RYGRELRRMSDEFE

SEQ ID NO: 129 - protein, 15 aa, Artificial Sequence
  BAD Peptide, biotin - labeled, synthesized
AGAGRSRHSSYPAGT

SEQ ID NO: 130 - protein, 24 aa, Artificial Sequence
  BAFF - R (160 - 183), synthesized
SVPVPATELGSTELVTTKTAGPEQ

SEQ ID NO: 131 - protein, 9 aa, Artificial Sequence
  BAGE (2 - 10), synthesized
AARAVFLAL

SEQ ID NO: 132 - protein, 16 aa, Artificial Sequence
  Bak BH3, synthesized
GQVGRQLAIIGDDINR

SEQ ID NO: 133 - protein, 21 aa, Artificial Sequence
  Bak BH3 (67 - 87), synthesized
PSSTMGQVGRQLAIIGDDINR

SEQ ID NO: 134 - protein, 25 aa, Artificial Sequence
  Bak BH3 (69 - 93), synthesized
STMGQVGRQLAIIGDDINRRYDSEF

SEQ ID NO: 135 - protein, 19 aa, Artificial Sequence
  Bak BH3 (71 - 89), synthesized
MGQVGRQLAIIGDDINRRY

SEQ ID NO: 136 - protein, 15 aa, Artificial Sequence
  Bak BH3 (73 - 87), synthesized
QVGRQLAIIGDDINR

SEQ ID NO: 137 - protein, 16 aa, Artificial Sequence
  Bax BH3, synthesized
KKLSECLKRIGDELDS

SEQ ID NO: 138 - protein, 14 aa, Artificial Sequence
  Bax BH3 (58 - 71), synthesized
KLSECLKRIGDELD

SEQ ID NO: 139 - protein, 16 aa, Artificial Sequence
  Bax BH3L63A, synthesized
KKLSECAKRIGDELDS

SEQ ID NO: 140 - protein, 34 aa, Artificial Sequence
  Bax H2 - H3 (53 - 86) Helix 2 - 3, synthesized
DASTKKLSECLKRIGDELDSNMELQRMIAAVDTD

SEQ ID NO: 141 - protein, 16 aa, Artificial Sequence
  Bax H3 (71 - 86) Helix 3 (71 - 86), synthesized
DSNMELQRMIAAVDTD

SEQ ID NO: 142 - protein, 26 aa, Artificial Sequence
  Bax I, synthesized
PQDASTKKLSECLKRIGDELDSNMEL

SEQ ID NO: 143 - protein, 21 aa, Artificial Sequence
  Bcl - 2 BH3 (85 - 105), synthesized
ALSPVPVVHLTLRQAGDFSRR

SEQ ID NO: 144 - protein, 25 aa, Artificial Sequence
  Bcl - 2 BH3 Peptide II, synthesized
LSPVPPVVHLALRQAGDDFSRRYRG

SEQ ID NO: 145 - protein, 25 aa, Artificial Sequence
  Bcl - 2 Binding Peptide  Bad BH3 Peptide, synthesized
LWAAQRYGRELRRMSDEFEGSFKGL

SEQ ID NO: 146 - protein, 14 aa, Artificial Sequence
  Bcl - XL BH3 (85 - 98), synthesized
AVKQALREAGDEFE

SEQ ID NO: 147 - protein, 45 aa, Artificial Sequence
  Bcl9 - 2, synthesized
  MOD_RES (45)..(45): AMIDATION
GSEGLSKEQLEHRERSFQTLRDIERLLLRSGETEPFLKGPPGGAG

SEQ ID NO: 148 - protein, 13 aa, Artificial Sequence
  BDC2.5(A), synthesized
GKKVAAPAWARMG

SEQ ID NO: 149 - protein, 20 aa, Artificial Sequence
  BH3 BIM Peptide (52 - 71), synthesized
  MOD_RES (1)..(1): ACETYLATION
MRPEIWIAQELRRIGDEFNA

SEQ ID NO: 150 - protein, 24 aa, Artificial Sequence
  Bid BH3 (77 - 100), synthesized
ESQEEIIHNIARHLAQIGDEMDHN

SEQ ID NO: 151 - protein, 21 aa, Artificial Sequence
  Bid BH3 (79 - 99), synthesized
QEDIIRNIARHLAQVGDSMDR

SEQ ID NO: 152 - protein, 14 aa, Artificial Sequence
  Bid BH3 (85 - 98), synthesized
NIARHLAQVGDSMD

SEQ ID NO: 153 - protein, 20 aa, Artificial Sequence
  Bid BH3 Peptide, synthesized
EDIIRNIARHLAQVGDSMDR

SEQ ID NO: 154 - protein, 20 aa, Artificial Sequence
  Bid BH3, synthesized
EDIIRNIARHLAQVGDSMDR

SEQ ID NO: 155 - protein, 21 aa, Artificial Sequence
  Bid BH3 - r8, synthesized
GEDIIRNIARHLAQVGDSMDR

SEQ ID NO: 156 - protein, 29 aa, Artificial Sequence
  Bid BH3 - R8, synthesized
RRRRRRRRGEDIIRNIARHLAQVGDSMDR

SEQ ID NO: 157 - protein, 30 aa, Artificial Sequence
  Bid BH3 - R9, synthesized
RRRRRRRRRGEDIIRNIARHLAQVGDSMDR

SEQ ID NO: 158 - protein, 16 aa, Artificial Sequence
  Bid - BH3, synthesized
RNIARHLAQVGDSMDR

SEQ ID NO: 159 - protein, 14 aa, Artificial Sequence
  Bik BH3 (50 - 70) (56 - 69), synthesized
ALALRLACIGDEMD

SEQ ID NO: 160 - protein, 20 aa, Artificial Sequence
  BIK BH3 Peptide, synthesized
MEGSDALALRLACIGDEMDV

SEQ ID NO: 161 - protein, 14 aa, Artificial Sequence
  Bim BH3 (87 - 100), synthesized
WIAQELRRIGDEFN

SEQ ID NO: 162 - protein, 25 aa, Artificial Sequence
  Bim BH3 Fragment I, synthesized
DNRPEIWIAQELRRIGDEFNAYYAR

SEQ ID NO: 163 - protein, 20 aa, Artificial Sequence
  Bim BH3  Fragment II, synthesized
MRPEIWIAQELRRIGDEFNA

SEQ ID NO: 164 - protein, 25 aa, Artificial Sequence
  Bim BH3  Peptide III, synthesized
DMRPEIWIAQELRRIGDEFNAYYAR

SEQ ID NO: 165 - protein, 26 aa, Artificial Sequence
  Bim BH3  Peptide IV, synthesized
DMRPEIWIAQELRRIGDEFNAYYARR

SEQ ID NO: 166 - protein, 10 aa, Artificial Sequence
  Bim - 23056, synthesized
  MISC_FEATURE (1)..(1): Xaa = d-Phenylalanine
  MISC_FEATURE (4)..(4): Xaa = D - Tryptophan
  MISC_FEATURE (8)..(8): Xaa = 3-Aminopyrrolidine-4-carboxylic Acid
  MISC_FEATURE (9)..(9): Xaa = D - Alanine
  MISC_FEATURE (10)..(10): Xaa = D - Leucine
XFYXKVFXXX

SEQ ID NO: 167 - protein, 20 aa, Artificial Sequence
  BMF BH3 peptide, synthesized
HQAEVQIARKLQLIADQFHR

SEQ ID NO: 168 - protein, 20 aa, Artificial Sequence
  BNIP3 - _ BH3 peptide, synthesized
VVEGEKEVEALKKSADWVSD

SEQ ID NO: 169 - protein, 10 aa, Artificial Sequence
  BRCAA1 (610 - 619), synthesized
SSKKQKRSHK

SEQ ID NO: 170 - protein, 10 aa, Artificial Sequence
  c - Myc peptide epitope, synthesized
EQKLISEEDL

SEQ ID NO: 171 - protein, 9 aa, Artificial Sequence
  Carcinoembryonic Antigen CEA   CAP - 1, synthesized
YLSGANLNL

SEQ ID NO: 172 - protein, 10 aa, Artificial Sequence
  CEA Related 1, synthesized
QYSWFVNGTF

SEQ ID NO: 173 - protein, 9 aa, Artificial Sequence
  CEA Related 2, synthesized
TYACFVSNL

SEQ ID NO: 174 - protein, 9 aa, Artificial Sequence
  Carcinoembryonic Antigen CEA  CAP - 1 - 6 - D  {Asp6}, synthesized
  MISC_FEATURE (6)..(6): Xaa = 3-Aminopyrrolidine-4-carboxylic Acid
YLSGAXLNL

SEQ ID NO: 175 - protein, 28 aa, Artificial Sequence
  Cell Penetrating ARF Peptide (26 - 44), synthesized
  MISC_FEATURE (1)..(1): Xaa = D - Arginine
  MISC_FEATURE (2)..(2): Xaa = D - Arginine
  MISC_FEATURE (3)..(3): Xaa = D - Arginine
  MISC_FEATURE (4)..(4): Xaa = D - Arginine
  MISC_FEATURE (5)..(5): Xaa = D - Arginine
  MISC_FEATURE (6)..(6): Xaa = D - Arginine
  MISC_FEATURE (7)..(7): Xaa = D - Arginine
  MISC_FEATURE (8)..(8): Xaa = D - Arginine
  MISC_FEATURE (9)..(9): Xaa = D - Arginine
XXXXXXXXXKFVRSRRPRTASCALAFVN

SEQ ID NO: 176 - protein, 17 aa, Artificial Sequence
  Cell Penetrating Mutant ARF (37 44), synthesized
  MISC_FEATURE (1)..(1): Xaa = D - Arginine
  MISC_FEATURE (2)..(2): Xaa = D - Arginine
  MISC_FEATURE (3)..(3): Xaa = D - Arginine
  MISC_FEATURE (4)..(4): Xaa = D - Arginine
  MISC_FEATURE (5)..(5): Xaa = D - Arginine
  MISC_FEATURE (6)..(6): Xaa = D - Arginine
  MISC_FEATURE (7)..(7): Xaa = D - Arginine
  MISC_FEATURE (8)..(8): Xaa = D - Arginine
  MISC_FEATURE (9)..(9): Xaa = D - Arginine
XXXXXXXXXSCALAFVN

SEQ ID NO: 177 - protein, 17 aa, Artificial Sequence
  Cripto - 1  CR - 1, synthesized
CPPSFYGRNCEHDVRKE

SEQ ID NO: 178 - protein, 10 aa, Artificial Sequence
  CTT  Gelatinase Inhibitor, synthesized
  DISULFID (1)..(10): Disulfide Bond
CTTHWGFTLC

SEQ ID NO: 179 - protein, 17 aa, Artificial Sequence
  Cys - p21 (139 - 154), synthesized
CGRKRRQTSMTDFYHSK

SEQ ID NO: 180 - protein, 20 aa, Artificial Sequence
  E7 (43 - 62)  HPV Oncoprotein, synthesized
GQAEPDRAHYNIVTFCCKCD

SEQ ID NO: 181 - protein, 35 aa, Artificial Sequence
  E7 (43 -77)  HPV Oncoprotein, synthesized
GQAEPDRAHYNIVTFCCKCDSTLRLCVQSTHVDIR

SEQ ID NO: 182 - protein, 21 aa, Artificial Sequence
  EGFR (662 - 681), synthesized
RRELVEPLTPSGEAPNQALLR

SEQ ID NO: 183 - protein, 9 aa, Artificial Sequence
  Ep - CAM (263 - 271), synthesized
GLKAGVIAV

SEQ ID NO: 184 - protein, 5 aa, Artificial Sequence
  Epidermal Mitosis Inhibiting Pentapeptide, synthesized
  MISC_FEATURE (1)..(1): Xaa = Pyroglutamic acid
XEDSG

SEQ ID NO: 185 - protein, 10 aa, Artificial Sequence
  F4.2  Gastric Signet Ring Cell Carcinoma Derived Peptide, synthesized
YSWMDISCWI

SEQ ID NO: 186 - protein, 9 aa, Artificial Sequence
  G154  gp100 (154 - 162), synthesized
KTWGQYWQV

SEQ ID NO: 187 - protein, 9 aa, Artificial Sequence
  G209  gp100 (209 - 217), synthesized
ITDQVPFSV

SEQ ID NO: 188 - protein, 9 aa, Artificial Sequence
  G209 - 2M  gp100 (209 - 217), synthesized
IMDQVPFSV

SEQ ID NO: 189 - protein, 10 aa, Artificial Sequence
  G280 - 9  gp100 (280 - 288), synthesized
YLEPGPVTAK

SEQ ID NO: 190 - protein, 10 aa, Artificial Sequence
  G280 - 9V  gp100(280 - 288), synthesized
YLEPGPVTVK

SEQ ID NO: 191 - protein, 15 aa, Artificial Sequence
  GAD65 (206 - 220), synthesized
TYEIAPVFVLLEYVT

SEQ ID NO: 192 - protein, 20 aa, Artificial Sequence
  GAD65 (78 - 97), synthesized
KPCNCPKGDVNYAFLHATDL

SEQ ID NO: 193 - protein, 10 aa, Artificial Sequence
  GnT - V (nt38 - 67), synthesized
VLPDVFIRCV

SEQ ID NO: 194 - protein, 10 aa, Artificial Sequence
  gp100 (177 - 186), synthesized
AMLGTHTMEV

SEQ ID NO: 195 - protein, 9 aa, Artificial Sequence
  gp100 (178 - 187), synthesized
MLGTHTMEV

SEQ ID NO: 196 - protein, 9 aa, Artificial Sequence
  gp100 (25 - 33)  human, synthesized
KVPRNQDWL

SEQ ID NO: 197 - protein, 10 aa, Artificial Sequence
  gp100 (457 - 466), synthesized
LLDGTATLRL

SEQ ID NO: 198 - protein, 10 aa, Artificial Sequence
  gp100 (476 - 485), synthesized
VLYRYGSFSV

SEQ ID NO: 199 - protein, 10 aa, Artificial Sequence
  gp100 (570 - 579), synthesized
SLADTNSLAV

SEQ ID NO: 200 - protein, 9 aa, Artificial Sequence
  gp100 (614 - 622), synthesized
LIYRRRLMK

SEQ ID NO: 201 - protein, 9 aa, Artificial Sequence
  gp100 (619 - 627), synthesized
RLMKQDFSV

SEQ ID NO: 202 - protein, 9 aa, Artificial Sequence
  gp100 (639 - 647), synthesized
RLPRIFCSC

SEQ ID NO: 203 - protein, 9 aa, Artificial Sequence
  GPC3 (144 - 152), synthesized
FVGEFFTDV

SEQ ID NO: 204 - protein, 9 aa, Artificial Sequence
  GPC3 (298 - 306), synthesized
EYILSLEEL

SEQ ID NO: 205 - protein, 24 aa, Artificial Sequence
  GRP78 Binding Chimeric Peptide Motif, synthesized
  MISC_FEATURE (11)..(11): Xaa = D - Lysine
  MISC_FEATURE (12)..(12): Xaa = D - Leucine
  MISC_FEATURE (13)..(13): Xaa = D - Alanine
  MISC_FEATURE (14)..(14): Xaa = D - Lysine
  MISC_FEATURE (15)..(15): Xaa = D - Leucine
  MISC_FEATURE (16)..(16): Xaa = D - Alanine
  MISC_FEATURE (17)..(17): Xaa = D - Lysine
  MISC_FEATURE (18)..(18): Xaa = D - Lysine
  MISC_FEATURE (19)..(19): Xaa = D - Leucine
  MISC_FEATURE (20)..(20): Xaa = D - Alanine
  MISC_FEATURE (21)..(21): Xaa = D - Lysine
  MISC_FEATURE (22)..(22): Xaa = D - Leucine
  MISC_FEATURE (23)..(23): Xaa = D - Alanine
  MOD_RES (24)..(24): AMIDATION
  MISC_FEATURE (24)..(24): Xaa = D - Lysine
WIFPWIQLGGXXXXXXXXXXXXXX

SEQ ID NO: 206 - protein, 14 aa, Artificial Sequence
  hACC1 (1258 - 1271)  phosphorylated, synthesized
  MISC_FEATURE (6)..(6): Xaa = phosphorolyated Serine
DSPPQXPTFPEAGH

SEQ ID NO: 207 - protein, 23 aa, Artificial Sequence
  HB - 1 (18 - 41), synthesized
WKSELVEVDDVYLRHSSSLTYRL

SEQ ID NO: 208 - protein, 16 aa, Artificial Sequence
  HB - 1 (26 - 41), synthesized
EDDVYLRHSSSLTYRL

SEQ ID NO: 209 - protein, 9 aa, Artificial Sequence
  HER - 2/Neu (654 - 662)  GP2, synthesized
IISAVVGIL

SEQ ID NO: 210 - protein, 19 aa, Artificial Sequence
  HIF - 1 {alpha} (556 - 574), synthesized
DLDLEMLAPYIPMDDDFQL

SEQ ID NO: 211 - protein, 19 aa, Artificial Sequence
  HIF - 2 (66 - 84), synthesized
SLEAQGIKADRETVAVKPT

SEQ ID NO: 212 - protein, 8 aa, Artificial Sequence
  HPV16 E7(86 - 93), synthesized
TLGIVCPI

SEQ ID NO: 213 - protein, 20 aa, Artificial Sequence
  HRK BH3 Peptide, synthesized
SSAAQLTAARLKALGDELHQ

SEQ ID NO: 214 - protein, 9 aa, Artificial Sequence
  IL - 11R - alpha Binding Peptide II, synthesized
  DISULFID (1)..(9): Disulfide Bond
CGRRAGGSC

SEQ ID NO: 215 - protein, 9 aa, Artificial Sequence
  iLRP1  iLRP  Immature Laminin Receptor Protein (58 - 66), synthesized
LLLAARAIV

SEQ ID NO: 216 - protein, 9 aa, Artificial Sequence
  iLRP2  iLRP (60 - 68), synthesized
LAARAIVAI

SEQ ID NO: 217 - protein, 9 aa, Artificial Sequence
  iLRP3  iLRP(146 - 154), synthesized
ALCNTDSPL

SEQ ID NO: 218 - protein, 9 aa, Artificial Sequence
  iLRP4  iLRP(7 - 15), synthesized
VLQMKEEDV

SEQ ID NO: 219 - protein, 13 aa, Artificial Sequence
  IP3 peptide, synthesized
MPRFMDYWEGLNK

SEQ ID NO: 220 - protein, 14 aa, Artificial Sequence
  IP3 peptide  Acetylated, synthesized
  MOD_RES (1)..(1): ACETYLATION
MPRFMDYWEGLNKK

SEQ ID NO: 221 - protein, 9 aa, Artificial Sequence
  IP3 Truncated Peptide  Acetylated, synthesized
  MOD_RES (1)..(1): ACETYLATION
FMDYWEGLN

SEQ ID NO: 222 - protein, 10 aa, Artificial Sequence
  Kisspeptin - 10  Metastin (45 - 54), synthesized
  MOD_RES (10)..(10): AMIDATION
YNWNSFGLRF

SEQ ID NO: 223 - protein, 10 aa, Artificial Sequence
  KM - HN - 1(107 - 116), synthesized
VFGTRIEKDL

SEQ ID NO: 224 - protein, 9 aa, Artificial Sequence
  KM - HN - 1(196 - 204), synthesized
NYNNFYRFL

SEQ ID NO: 225 - protein, 9 aa, Artificial Sequence
  KM - HN - 1(335 - 343), synthesized
HFCRKCKKL

SEQ ID NO: 226 - protein, 10 aa, Artificial Sequence
  KM - HN - 1(499 - 508), synthesized
EYSKECLKEF

SEQ ID NO: 227 - protein, 10 aa, Artificial Sequence
  KM - HN - 1(65 - 74), synthesized
SFQALRMQTL

SEQ ID NO: 228 - protein, 9 aa, Artificial Sequence
  KM - HN - 1(770 - 778), synthesized
EYLSLSDKI

SEQ ID NO: 229 - protein, 9 aa, Artificial Sequence
  Laminin Peptide (CDPGYIGSR)  NEW, synthesized
  MOD_RES (9)..(9): AMIDATION
CDPGYIGSR

SEQ ID NO: 230 - protein, 10 aa, Artificial Sequence
  Livin7  ML - IAP, synthesized
KWFPSCQFLL

SEQ ID NO: 231 - protein, 9 aa, Artificial Sequence
  LyP - 1  Peptide 1, synthesized
  DISULFID (1)..(9): Disulfide Bond
CGNKRTRGC

SEQ ID NO: 232 - protein, 9 aa, Artificial Sequence
  LyP - 1  Peptide 2, synthesized
CGNKRTRGC

SEQ ID NO: 233 - protein, 9 aa, Artificial Sequence
  MAGE - 1 (161 - 169), synthesized
EADPTGHSY

SEQ ID NO: 234 - protein, 9 aa, Artificial Sequence
  MAGE - 1 (230 - 238), synthesized
STAPPAHGV

SEQ ID NO: 235 - protein, 9 aa, Artificial Sequence
  MAGE - 3 (112 - 120), synthesized
KVAELVHFL

SEQ ID NO: 236 - protein, 14 aa, Artificial Sequence
  MAGE - 3 (114 - 127), synthesized
AELVHFLLLKYRAR

SEQ ID NO: 237 - protein, 14 aa, Artificial Sequence
  MAGE - 3 (121 - 134), synthesized
LLKYRAREPVTKAE

SEQ ID NO: 238 - protein, 9 aa, Artificial Sequence
  MAGE - 3 (161 - 169), synthesized
EVDPIGHLY

SEQ ID NO: 239 - protein, 9 aa, Artificial Sequence
  MAGE - 3 (271 - 279), synthesized
FLWGPRALV

SEQ ID NO: 240 - protein, 9 aa, Artificial Sequence
  MAGE - A 1(96 - 104), synthesized
SLFRAVITK

SEQ ID NO: 241 - protein, 9 aa, Artificial Sequence
  MAGE - A1 (237 - 245), synthesized
KLLTQDLVQ

SEQ ID NO: 242 - protein, 9 aa, Artificial Sequence
  MAGE - A1 Antigen (278 - 286), synthesized
KVLEYVIKV

SEQ ID NO: 243 - protein, 9 aa, Artificial Sequence
  MAGE - A10 (183 - 191), synthesized
MLLVFGIDV

SEQ ID NO: 244 - protein, 9 aa, Artificial Sequence
  MAGE - A10 (254 - 262), synthesized
GLYDGMEHL

SEQ ID NO: 245 - protein, 9 aa, Artificial Sequence
  MAGE - A2 (112 - 120), synthesized
KMVELVHFL

SEQ ID NO: 246 - protein, 10 aa, Artificial Sequence
  MAGE - A2 (157 - 166), synthesized
YLQLVFGIEV

SEQ ID NO: 247 - protein, 10 aa, Artificial Sequence
  MAGE - A3 (167 - 176), synthesized
MEVDPIGHLY

SEQ ID NO: 248 - protein, 9 aa, Artificial Sequence
  MAGE - A3 (195 - 203), synthesized
IMPKAGLLI

SEQ ID NO: 249 - protein, 10 aa, Artificial Sequence
  MAGE - A4 Antigen (230 - 239), synthesized
GVYDGREHTV

SEQ ID NO: 250 - protein, 9 aa, Artificial Sequence
  MAGE - C2 (336 - 344), synthesized
ALKDVEERV

SEQ ID NO: 251 - protein, 9 aa, Artificial Sequence
  Malaria CSP (334 - 342), synthesized
YLKKIKNSL

SEQ ID NO: 252 - protein, 16 aa, Artificial Sequence
  Maspin Reactive Site Loop (RSL)  (330 - 345), synthesized
GGDSIEVPGARILQHK

SEQ ID NO: 253 - protein, 11 aa, Artificial Sequence
  Melan - A/MART - 1 (24 - 34), synthesized
AEEAAGIGILT

SEQ ID NO: 254 - protein, 9 aa, Artificial Sequence
  Melanoma Antigen Family A 3 (196 - 204); MAGE - 3 (196 - 204), synthesized
MPKAGLLII

SEQ ID NO: 255 - protein, 9 aa, Artificial Sequence
  Melanoma Antigen Family A 8 (115 - 123); MAGE - 8 (115 - 123), synthesized
KVAELVRFL

SEQ ID NO: 256 - protein, 9 aa, Artificial Sequence
  Melanoma Antigen Family A 9B (223 - 231)  MAGE - 9B (223 - 231), synthesized
ALSVMGVYV

SEQ ID NO: 257 - protein, 11 aa, Artificial Sequence
  Melanosomal Antigen II, synthesized
DAEKCDKTDEY

SEQ ID NO: 258 - protein, 20 aa, Artificial Sequence
  MUC1  tandem repeat fragment, synthesized
PDTRPAPGSTAPPAHGVTSA

SEQ ID NO: 259 - protein, 16 aa, Artificial Sequence
  MUC5AC 3, synthesized
  MISC_FEATURE (3)..(3): Xaa = GalNAc labeled Threonine
GTXPSPVPTTSTTSAP

SEQ ID NO: 260 - protein, 16 aa, Artificial Sequence
  MUC5AC  Analog 1, synthesized
GTTPSPVPTTSTTSAP

SEQ ID NO: 261 - protein, 11 aa, Artificial Sequence
  MUC5AC  Analog B, synthesized
TTSTTSAPTTS

SEQ ID NO: 262 - protein, 16 aa, Artificial Sequence
  MUC5AC - 13, synthesized
  MISC_FEATURE (13)..(13): Xaa = GalNAc labeled Threonine
GTTPSPVPTTSTXSAP

SEQ ID NO: 263 - protein, 16 aa, Artificial Sequence
  MUC5AC - 3/13, synthesized
  MISC_FEATURE (3)..(3): Xaa = GalNAc labeled Threonine
  MISC_FEATURE (13)..(13): Xaa = GalNAc labeled Threonine
GTXPSPVPTTSTXSAP

SEQ ID NO: 264 - protein, 9 aa, Artificial Sequence
  MUM - 1 (261 - 269), synthesized
EEKLIVVLF

SEQ ID NO: 265 - protein, 9 aa, Artificial Sequence
  MycC Peptide, synthesized
YEQLRNSRA

SEQ ID NO: 266 - protein, 8 aa, Artificial Sequence
  MZ2 - F, synthesized
YRPRPRRY

SEQ ID NO: 267 - protein, 11 aa, Artificial Sequence
  NES Adenoviral E1A, synthesized
VMLAVQEGIDL

SEQ ID NO: 268 - protein, 10 aa, Artificial Sequence
  NES Nmd3p (491 - 500), synthesized
INIDELLDEL

SEQ ID NO: 269 - protein, 17 aa, Artificial Sequence
  NES p120ctn, synthesized
CSLEEELDVLVLDDEGG

SEQ ID NO: 270 - protein, 13 aa, Artificial Sequence
  NES Topoisomerase II alpha (1054 - 1066), synthesized
FILEKIDGKIIIE

SEQ ID NO: 271 - protein, 20 aa, Artificial Sequence
  Noxa A BH3 peptide, synthesized
AELPPEFAAQLRKIGDKVYC

SEQ ID NO: 272 - protein, 29 aa, Artificial Sequence
  Noxa A BH3 peptide cell permeable, synthesized
  MISC_FEATURE (1)..(1): Xaa = D - Arginine
  MISC_FEATURE (2)..(2): Xaa = D - Arginine
  MISC_FEATURE (3)..(3): Xaa = D - Arginine
  MISC_FEATURE (4)..(4): Xaa = D - Arginine
  MISC_FEATURE (5)..(5): Xaa = D - Arginine
  MISC_FEATURE (6)..(6): Xaa = D - Arginine
  MISC_FEATURE (7)..(7): Xaa = D - Arginine
  MISC_FEATURE (8)..(8): Xaa = D - Arginine
XXXXXXXXGAELPPEFAAQLRKIGDKVYC

SEQ ID NO: 273 - protein, 9 aa, Artificial Sequence
  NuBCP - 9 A, synthesized
FSRSLHSLL

SEQ ID NO: 274 - protein, 12 aa, Artificial Sequence
  Nuclear Export Signal  NES HIV Rev, synthesized
LQLPPLERLTLD

SEQ ID NO: 275 - protein, 12 aa, Artificial Sequence
  Nuclear Export Signal  NES MAPKK, synthesized
ALQKKLEELELD

SEQ ID NO: 276 - protein, 12 aa, Artificial Sequence
  Nuclear Export Signal  NES p53, synthesized
FRELNEALELKD

SEQ ID NO: 277 - protein, 10 aa, Artificial Sequence
  NY - ESO - 1 (53 - 62), synthesized
ASGPGGGAPR

SEQ ID NO: 278 - protein, 10 aa, Artificial Sequence
  ORF5 fragment, synthesized
PASKKTDPQK

SEQ ID NO: 279 - protein, 8 aa, Artificial Sequence
  p21 (140 - 147), synthesized
RKRRQTSM

SEQ ID NO: 280 - protein, 9 aa, Artificial Sequence
  p53 (12 - 20), synthesized
PPLSQETFS

SEQ ID NO: 281 - protein, 10 aa, Artificial Sequence
  p53 (17 - 26), synthesized
ETFSDLWKLL

SEQ ID NO: 282 - protein, 10 aa, Artificial Sequence
  p53 (17 - 26), synthesized
  MOD_RES (10)..(10): AMIDATION
ETFSDLWKLL

SEQ ID NO: 283 - protein, 9 aa, Artificial Sequence
  p53 (65 - 73), synthesized
RMPEAAPPV

SEQ ID NO: 284 - protein, 11 aa, Artificial Sequence
  p53 Mutant Form (361 - 371)  Pab 421, synthesized
  MOD_RES (11)..(11): AMIDATION
KKGQSTSRHKK

SEQ ID NO: 285 - protein, 33 aa, homo sapiens
GSRAHSSHLKSKKGQSTSRHKKLMFKTEGPDSD

SEQ ID NO: 286 - protein, 33 aa, homo sapiens; identical to SEQ ID NO: 285
  MOD_RES (33)..(33): AMIDATION

SEQ ID NO: 287 - protein, 15 aa, Artificial Sequence
  p53  (12 - 26), synthesized
PPLSQETFSDLWKLL

SEQ ID NO: 288 - protein, 18 aa, Artificial Sequence
  Pirh2 - Derived Peptide (CDB62) (120 - 137), synthesized
LKCNLCLTTNLRGKHKCI

SEQ ID NO: 289 - protein, 27 aa, Artificial Sequence
  PNC - 28  MDM Binding Domain, synthesized
ETFSDLWKLLKKWKMRRNQFWVKVQRG

SEQ ID NO: 290 - protein, 10 aa, Artificial Sequence
  PRAME epitope (PRA300 - 309) Tumor - associated antigen, synthesized
ALYVDSLFFL

SEQ ID NO: 291 - protein, 12 aa, Artificial Sequence
  Pro - TGF - B, synthesized
HADLLAVVAASQ

SEQ ID NO: 292 - protein, 12 aa, Artificial Sequence
  Pro - TGF - B, synthesized
HADLLAVVAASQ

SEQ ID NO: 293 - protein, 8 aa, Artificial Sequence
  Prostate Vasculature Marker, synthesized
SMSIARLK

SEQ ID NO: 294 - protein, 7 aa, Artificial Sequence
  Prostate - Specific Antigen  PSA propeptide, synthesized
APLILSR

SEQ ID NO: 295 - protein, 10 aa, Artificial Sequence
  PSA1(141 - 150), synthesized
FLTPKKLQCV

SEQ ID NO: 296 - protein, 9 aa, Artificial Sequence
  PSA2 (146 - 154), synthesized
KLQCVDLHV

SEQ ID NO: 297 - protein, 21 aa, Artificial Sequence
  Rab24 (179 - 199), synthesized
QVMTEDKGVDLSQKANPYFYS

SEQ ID NO: 298 - protein, 16 aa, Artificial Sequence
  Rad51 (175 - 190) (CDB55), synthesized
AERYGLSGSDVLDNVA

SEQ ID NO: 299 - protein, 12 aa, Artificial Sequence
  Rad51 (179 - 190), synthesized
GLSGSDVLDNVA

SEQ ID NO: 300 - protein, 10 aa, Artificial Sequence
  RAGE derived peptide, synthesized
SPSSNRIRNT

SEQ ID NO: 301 - protein, 9 aa, Artificial Sequence
  Shepherdin (79 - 87), synthesized
KHSSGCAFL

SEQ ID NO: 302 - protein, 9 aa, Artificial Sequence
  Stromal Target Antigen, synthesized
SIYYYRYGL

SEQ ID NO: 303 - protein, 10 aa, Artificial Sequence
  STT Gelatinase Inhibitor modification  negative control, synthesized
STTHWGFTLS

SEQ ID NO: 304 - protein, 10 aa, Artificial Sequence
  Survivin, synthesized
ELTLGEFLKL

SEQ ID NO: 305 - protein, 9 aa, Artificial Sequence
  Survivin (85 - 93), synthesized
AFLSVKKQF

SEQ ID NO: 306 - protein, 9 aa, Artificial Sequence
  Survivin 2B (80 - 88), synthesized
AYACNTSTL

SEQ ID NO: 307 - protein, 9 aa, Artificial Sequence
  Telomerase Reverse Transcriptase p572Y (TERT572Y), synthesized
RLFFYRKSV

SEQ ID NO: 308 - protein, 18 aa, Artificial Sequence
  TP53 Q9NP68  p53 Mutant Form (361 - 377)  Lys371 (Ac), synthesized
  MISC_FEATURE (11)..(11): Xaa = Acetylated Lysine
KKGQSTSRHKXLMFKTEG

SEQ ID NO: 309 - protein, 8 aa, Artificial Sequence
  TRP - 1  Fragment, synthesized
MSLQRQFL

SEQ ID NO: 310 - protein, 9 aa, Artificial Sequence
  TRP - 2 (180 - 188)  NEW, synthesized
SVYDFFVWL

SEQ ID NO: 311 - protein, 9 aa, Artificial Sequence
  TRP - 2 coding region fragment, synthesized
LLPGGRPYR

SEQ ID NO: 312 - protein, 17 aa, homo sapiens
ASFKLQRQNRVDSKETE

SEQ ID NO: 313 - protein, 11 aa, Artificial Sequence
  Tyrosinase (146 - 156), synthesized
SSDYVIPIGTY

SEQ ID NO: 314 - protein, 9 aa, Artificial Sequence
  Tyrosinase (192 - 200), synthesized
SEIWRDIDF

SEQ ID NO: 315 - protein, 9 aa, Artificial Sequence
  Tyrosinase (206 - 214)  T9206, synthesized
AFLPWHRLF

SEQ ID NO: 316 - protein, 12 aa, Artificial Sequence
  Tyrosinase (240 - 251), synthesized
DAEKCDICTDEY

SEQ ID NO: 317 - protein, 13 aa, Artificial Sequence
  Tyrosinase (450 - 462), synthesized
SYLQDSDPDSFQD

SEQ ID NO: 318 - protein, 15 aa, Artificial Sequence
  Tyrosinase (56 - 70), synthesized
QNILLSNAPLGPQFP

SEQ ID NO: 319 - protein, 9 aa, Artificial Sequence
  Tyrosinase(243 - 251) core nonamer sequence, synthesized
KCDICTDEY

SEQ ID NO: 320 - protein, 10 aa, Artificial Sequence
  VEGFR - 2/KDR I  murine, synthesized
FSNSTNDILI

SEQ ID NO: 321 - protein, 9 aa, Artificial Sequence
  VEGFR - 2/KDR II  murine, synthesized
VILTNPISM

SEQ ID NO: 322 - protein, 7 aa, Artificial Sequence
  VEGFR2/KDR Antagonist, synthesized
ATWLPPR

SEQ ID NO: 323 - protein, 9 aa, Artificial Sequence
  WP9QY  TNF - alpha Antagonist, synthesized
  DISULFID (2)..(8): Disulfide Bond
YCWSQYLCY

SEQ ID NO: 324 - protein, 20 aa, homo sapiens
SKISASRKLQLKTLLLQIAK

SEQ ID NO: 325 - protein, 45 aa, Artificial Sequence
  CART (55 - 102), synthesized
VPIYEKKYGQVPMCDAGEQCAVRKGARIGKLCDCPRGTSCNSFLL

SEQ ID NO: 326 - protein, 7 aa, Artificial Sequence
  Casomorphin (1 - 7), synthesized
YPFVEPI

SEQ ID NO: 327 - protein, 4 aa, Artificial Sequence
  Caspase 1 (ICE) Inhibitor I, synthesized
  MOD_RES (1)..(1): ACETYLATION
YVAD

SEQ ID NO: 328 - protein, 5 aa, Artificial Sequence
  Caspase 1 (ICE) Substrate 1, synthesized
  MOD_RES (1)..(1): ACETYLATION
  MISC_FEATURE (5)..(5): Xaa = PARANITROANILIDE
YEVDX

SEQ ID NO: 329 - protein, 4 aa, Artificial Sequence
  Caspase 1 (ICE) Substrate 1m, synthesized
  MOD_RES (1)..(1): ACETYLATION
YEVD

SEQ ID NO: 330 - protein, 5 aa, Artificial Sequence
  Caspase 1 (ICE) Substrate 2, synthesized
  MOD_RES (1)..(1): ACETYLATION
  MISC_FEATURE (5)..(5): Xaa = PARANITROANILIDE
YVADX

SEQ ID NO: 331 - protein, 4 aa, Artificial Sequence
  Caspase 1 (ICE) Substrate 3f, synthesized
  MOD_RES (1)..(1): ACETYLATION
WEHD

SEQ ID NO: 332 - protein, 4 aa, Artificial Sequence
  Caspase 1 (ICE) Substrate 3m, synthesized
  MOD_RES (1)..(1): ACETYLATION
WEHD

SEQ ID NO: 333 - protein, 7 aa, Artificial Sequence
  Caspase 1 (ICE), synthesized
YVADAPV

SEQ ID NO: 334 - protein, 5 aa, Artificial Sequence
  Caspase 1 Substrate III, synthesized
  MOD_RES (1)..(1): ACETYLATION
  MISC_FEATURE (5)..(5): Xaa = PARANITROANILIDE
WEHDX

SEQ ID NO: 335 - protein, 6 aa, Artificial Sequence
  Caspase 2 (ICH - 1) Substrate 1, synthesized
  MOD_RES (1)..(1): ACETYLATION
  MISC_FEATURE (6)..(6): Xaa = PARANITROANILIDE
VDVADX

SEQ ID NO: 336 - protein, 8 aa, Artificial Sequence
  Caspase 2 (ICH - 1) Substrate 2, synthesized
  MOD_RES (8)..(8): AMIDATION
VDVADGWK

SEQ ID NO: 337 - protein, 5 aa, Artificial Sequence
  Caspase 2 Inhibitor, synthesized
  MOD_RES (1)..(1): ACETYLATION
VDVAD

SEQ ID NO: 338 - protein, 6 aa, Artificial Sequence
  Caspase 2 Substrate, synthesized
  MOD_RES (1)..(1): ACETYLATION
  MISC_FEATURE (6)..(6): Xaa = PARANITROANILIDE
VDQQDX

SEQ ID NO: 339 - protein, 13 aa, Artificial Sequence
  Caspase 3 (163 - 175), synthesized
CRGTELDCGIETD

SEQ ID NO: 340 - protein, 4 aa, Artificial Sequence
  Caspase 3 (Apopain) Inhibitor 1, synthesized
  MOD_RES (1)..(1): ACETYLATION
DEVD

SEQ ID NO: 341 - protein, 4 aa, Artificial Sequence
  Caspase 3 (Apopain) Inhibitor 1b, synthesized
DEVD

SEQ ID NO: 342 - protein, 5 aa, Artificial Sequence
  Caspase 3 (Apopain) Substrate 2, synthesized
  MOD_RES (1)..(1): ACETYLATION
  MISC_FEATURE (5)..(5): Xaa = PARANITROANILIDE
DQMDX

SEQ ID NO: 343 - protein, 4 aa, Artificial Sequence
  Caspase 3 Inhibitor 1, synthesized
  MOD_RES (1)..(1): ACETYLATION
DMQD

SEQ ID NO: 344 - protein, 5 aa, Artificial Sequence
  Caspase 3 Substrate 1, synthesized
  MOD_RES (1)..(1): ACETYLATION
  MISC_FEATURE (5)..(5): Xaa = PARANITROANILIDE
DMQDX

SEQ ID NO: 345 - protein, 5 aa, Artificial Sequence
  Caspase 3 Substrate, synthesized
  MOD_RES (1)..(1): ACETYLATION
  MISC_FEATURE (5)..(5): Xaa = PARANITROANILIDE
VQVDX

SEQ ID NO: 346 - protein, 5 aa, Artificial Sequence
  Caspase 4 (ICH - 2) Substrate 1, synthesized
  MOD_RES (1)..(1): ACETYLATION
  MISC_FEATURE (5)..(5): Xaa = PARANITROANILIDE
LEVDX

SEQ ID NO: 347 - protein, 4 aa, Artificial Sequence
  Caspase 6 (Mch 2) Inhibitor 1, synthesized
  MOD_RES (1)..(1): ACETYLATION
VEID

SEQ ID NO: 348 - protein, 5 aa, Artificial Sequence
  Caspase 6 (Mch2) Substrate 1, synthesized
  MOD_RES (1)..(1): ACETYLATION
  MISC_FEATURE (5)..(5): Xaa = PARANITROANILIDE
VEIDX

SEQ ID NO: 349 - protein, 18 aa, Artificial Sequence
  ICE Inhibitor I, synthesized
  MOD_RES (1)..(1): ACETYLATION
AAVLPAVLLALLAPYVAD

SEQ ID NO: 350 - protein, 7 aa, Artificial Sequence
  Smac N7 Protein, synthesized
AVPIAQK

SEQ ID NO: 351 - protein, 11 aa, Artificial Sequence
  37 43Gap 27  Connexin Mimetic, synthesized
SRPTEKTIFII

SEQ ID NO: 352 - protein, 13 aa, Artificial Sequence
  37  40 GAP26  Connexin Mimetic, synthesized
VCYDQAFPISHIR

SEQ ID NO: 353 - protein, 11 aa, Artificial Sequence
  40Gap 27  Connexin Mimetic, synthesized
SRPTEKNVFIV

SEQ ID NO: 354 - protein, 13 aa, Artificial Sequence
  43Gap 26  Connexin Mimetic, synthesized
VCYDKSFPISHVR

SEQ ID NO: 355 - protein, 18 aa, Artificial Sequence
  43Gap 36  Connexin Mimetic, synthesized
KRDPCHQVDCFLSRPTEK

SEQ ID NO: 356 - protein, 20 aa, Artificial Sequence
  Alpha B - Crystallin (73 - 92), synthesized
DRFSVNLDVKHFSPEELKVK

SEQ ID NO: 357 - protein, 10 aa, Artificial Sequence
  Calreticulin (CRT) Binding Peptide 1, synthesized
GQPMYGQPMY

SEQ ID NO: 358 - protein, 21 aa, Artificial Sequence
  DAM1 (221 - 241), synthesized
SFVLNPTNIGMSKSSQGHVTK

SEQ ID NO: 359 - protein, 12 aa, Artificial Sequence
  Hyaluronan Inhibitor, synthesized
GAHWQFNALTVR

SEQ ID NO: 360 - protein, 20 aa, Artificial Sequence
  L1CD cell adhesion molecule (1144 - 1163), synthesized
KRSKGGKYSVKDKEDTQVDS

SEQ ID NO: 361 - protein, 13 aa, Artificial Sequence
  L1FLCD (1173 - 1185), synthesized
FGEYRSLESDNEE

SEQ ID NO: 362 - protein, 9 aa, Artificial Sequence
  pALA  Polyalanine Peptide, synthesized
AAADAAAAL

SEQ ID NO: 363 - protein, 45 aa, Artificial Sequence
  S1P1, synthesized
VSTSIPEVKALRSSVSDYGNYDIIVRHYNYTGKLNIGAEKDHGIK

SEQ ID NO: 364 - protein, 16 aa, Artificial Sequence
  Pen2W2F, synthesized
  MOD_RES (16)..(16): AMIDATION
RQIKIFFQNRRMKFKK

SEQ ID NO: 365 - protein, 18 aa, Artificial Sequence
  Hel 11 - 7  NEW, synthesized
KLLKLLLKLWLKLLKLLL

SEQ ID NO: 366 - protein, 17 aa, Artificial Sequence
  HIV - 1 Rev (34 - 50), synthesized
TRQARRNRRRRWRERQR

SEQ ID NO: 367 - protein, 13 aa, Artificial Sequence
  HIV - 1 Tat (48 - 60), synthesized
GRKKRRQRRRPPQ

SEQ ID NO: 368 - protein, 13 aa, Artificial Sequence
  Human T - cell Lymphotrophic Virus (HTLV) - II Rex  (4 - 16), synthesized
TRRQRTRRARRNR

SEQ ID NO: 369 - protein, 15 aa, Artificial Sequence
  Lipid Membrane Translocating Peptide, synthesized
KKAAAVLLPVLLAAP

SEQ ID NO: 370 - protein, 15 aa, Artificial Sequence
  Lipid Membrane Translocating Peptide  D, synthesized
  MISC_FEATURE (1)..(1): Xaa = D - Lysine
  MISC_FEATURE (2)..(2): Xaa = D - Lysine
  MISC_FEATURE (3)..(3): Xaa = D - Alanine
  MISC_FEATURE (4)..(4): Xaa = D - Alanine
  MISC_FEATURE (5)..(5): Xaa = D - Alanine
  MISC_FEATURE (6)..(6): Xaa = Beta-3 homo- Valine
  MISC_FEATURE (7)..(7): Xaa = D - Leucine
  MISC_FEATURE (8)..(8): Xaa = D - Leucine
  MISC_FEATURE (9)..(9): Xaa = D -  Proline
  MISC_FEATURE (10)..(10): Xaa = D - Valine
  MISC_FEATURE (11)..(11): Xaa = D - Leucine
  MISC_FEATURE (12)..(12): Xaa = D - Leucine
  MISC_FEATURE (13)..(13): Xaa = D - Alanine
  MISC_FEATURE (14)..(14): Xaa = D - Alanine
  MISC_FEATURE (15)..(15): Xaa = D -  Proline
XXXXXXXXXXXXXXX

SEQ ID NO: 371 - protein, 14 aa, Artificial Sequence
  Mastoparan, synthesized
  MOD_RES (14)..(14): AMIDATION
INLKALAALAKKIL

SEQ ID NO: 372 - protein, 14 aa, Artificial Sequence
  Mastoparan 7, synthesized
  MOD_RES (14)..(14): AMIDATION
INLKALAALAKALL

SEQ ID NO: 373 - protein, 14 aa, Artificial Sequence
  Mastoparan X, synthesized
  MOD_RES (14)..(14): AMIDATION
INWKGIAAMAKKLL

SEQ ID NO: 374 - protein, 13 aa, Artificial Sequence
  MEK1 Derived Peptide Inhibitor 1, synthesized
MPKKKPTPIQLNP

SEQ ID NO: 375 - protein, 16 aa, Artificial Sequence
  Membrane - Permeable Sequence  MPS, synthesized
AAVALLPAVLLALLAK

SEQ ID NO: 376 - protein, 27 aa, Artificial Sequence
  MPG_NLS, synthesized
GALFLGFLGAAGSTMGAWSQPKSKRKV

SEQ ID NO: 377 - protein, 25 aa, Artificial Sequence
  MPS - G_i2, synthesized
AAVALLPAVLLALLAKNNLKDCGLF

SEQ ID NO: 378 - protein, 25 aa, Artificial Sequence
  MPS - G_i3, synthesized
AAVALLPAVLLALLAKNNLKECGLY

SEQ ID NO: 379 - protein, 21 aa, Artificial Sequence
  NGR Peptide 1, synthesized
  DISULFID (1)..(5): Disulfide Bond
  MISC_FEATURE (8)..(8): Xaa = D - Lysine
  MISC_FEATURE (9)..(9): Xaa = D - Leucine
  MISC_FEATURE (10)..(10): Xaa = D - Alanine
  MISC_FEATURE (11)..(11): Xaa = D - Lysine
  MISC_FEATURE (12)..(12): Xaa = D - Leucine
  MISC_FEATURE (13)..(13): Xaa = D - Alanine
  MISC_FEATURE (14)..(14): Xaa = D - Lysine
  MISC_FEATURE (15)..(15): Xaa = D - Lysine
  MISC_FEATURE (16)..(16): Xaa = D - Leucine
  MISC_FEATURE (17)..(17): Xaa = D - Alanine
  MISC_FEATURE (18)..(18): Xaa = D - Lysine
  MISC_FEATURE (19)..(19): Xaa = D - Leucine
  MISC_FEATURE (20)..(20): Xaa = D - Alanine
  MOD_RES (21)..(21): AMIDATION
  MISC_FEATURE (21)..(21): Xaa = D - Lysine
CNGRCGGXXXXXXXXXXXXXX

SEQ ID NO: 380 - protein, 11 aa, Artificial Sequence
  NGR Peptide 2, synthesized
  DISULFID (1)..(5): Disulfide Bond
CNGRCGGLVTT

SEQ ID NO: 381 - protein, 5 aa, Artificial Sequence
  NGR Peptide 3, synthesized
  DISULFID (1)..(5): Disulfide Bond
  MOD_RES (5)..(5): AMIDATION
CNGRC

SEQ ID NO: 382 - protein, 17 aa, Artificial Sequence
  NGR Peptide 4, synthesized
  DISULFID (1)..(5): Disulfide Bond
  MISC_FEATURE (8)..(8): Xaa = D - Lysine
  MISC_FEATURE (9)..(9): Xaa = D - Lysine
  MISC_FEATURE (10)..(10): Xaa = D - Leucine
  MISC_FEATURE (11)..(11): Xaa = D - Lysine
  MISC_FEATURE (12)..(12): Xaa = D - Leucine
  MISC_FEATURE (13)..(13): Xaa = D - Leucine
  MISC_FEATURE (14)..(14): Xaa = D - Leucine
  MISC_FEATURE (15)..(15): Xaa = D - Lysine
  MISC_FEATURE (16)..(16): Xaa = D - Leucine
  MISC_FEATURE (17)..(17): Xaa = D - Leucine
CNGRCGGXXXXXXXXXX

SEQ ID NO: 383 - protein, 7 aa, Artificial Sequence
  Nuclear Localiation Signal Peptide, synthesized
PKKKRKV

SEQ ID NO: 384 - protein, 17 aa, Artificial Sequence
  P22 N (14 - 30), synthesized
NAKTRRHERRRKLAIER

SEQ ID NO: 385 - protein, 16 aa, Artificial Sequence
  PenArg, synthesized
  MOD_RES (16)..(16): AMIDATION
RQIRIWFQNRRMRWRR

SEQ ID NO: 386 - protein, 21 aa, Artificial Sequence
  Pep - 1 - Cysteamine, synthesized
  MOD_RES (1)..(1): ACETYLATION
KETWWETWWTEWSQPKKKRKV

SEQ ID NO: 387 - protein, 21 aa, Artificial Sequence
  Pep - 1: Chariot, synthesized
KETWWETWWTEWSQPKKKRKV

SEQ ID NO: 388 - protein, 18 aa, Artificial Sequence
  phi 21 N Peptide (12 - 29), synthesized
TAKTRYKARRAELIAERR

SEQ ID NO: 389 - protein, 11 aa, Artificial Sequence
  Phospho - IkBa - derived peptide, synthesized
  MISC_FEATURE (9)..(9): Xaa = phosphorolyated Serine
  MOD_RES (11)..(11): AMIDATION
GRHDSGLDXMK

SEQ ID NO: 390 - protein, 29 aa, Artificial Sequence
  Rabies Virus Glycoprotein (RVG), synthesized
YTIWMPENPRPGTPCDIFTNSRGKRASNG

SEQ ID NO: 391 - protein, 29 aa, Artificial Sequence
  Rabies Virus Matrix Protein Fragment (RV - MAT), synthesized
MNLLRKIVKNRRDEDTQKSSPASAPLDDG

SEQ ID NO: 392 - protein, 13 aa, Artificial Sequence
  MEK - 1 Derived Peptide Inhibitor 1  amide, synthesized
  MOD_RES (13)..(13): AMIDATION
MPKKKPTPIQLNP

SEQ ID NO: 393 - protein, 13 aa, Artificial Sequence
  SV - 40 Large T, synthesized
CGGGPKKKRKVED

SEQ ID NO: 394 - protein, 12 aa, Artificial Sequence
  SV40 T - Ag, synthesized
PKKKRKVEDPYC

SEQ ID NO: 395 - protein, 19 aa, Artificial Sequence
  SynB1, synthesized
RGGRLSYSRRRFSTSTGRA

SEQ ID NO: 396 - protein, 11 aa, Artificial Sequence
  TAT (47 - 57), synthesized
YGRKKRRQRRR

SEQ ID NO: 397 - protein, 10 aa, Artificial Sequence
  Tat (48 - 57), synthesized
GRKKRRQRRR

SEQ ID NO: 398 - protein, 11 aa, Artificial Sequence
  Tat - C (48 - 57), synthesized
CGRKKRRQRRR

SEQ ID NO: 399 - protein, 20 aa, Artificial Sequence
  Tat - NR2Bct, synthesized
YGRKKRRQRRRKLSSIESDV

SEQ ID NO: 400 - protein, 35 aa, Artificial Sequence
  TAT - NSF222 Fusion Peptide, synthesized
YGRKKRRQRRRGGGLDKEFNSIFRRAFASRVFPPE

SEQ ID NO: 401 - protein, 36 aa, Artificial Sequence
  TAT - NSF700 Fusion Peptide, synthesized
YGRKKRRQRRRGGGLLDYVPIGPRFSNLVLQALLVL

SEQ ID NO: 402 - protein, 9 aa, Artificial Sequence
  Transdermal Peptide, synthesized
  MOD_RES (1)..(1): ACETYLATION
SSSPSKHCG

SEQ ID NO: 403 - protein, 27 aa, Artificial Sequence
  Transportan, synthesized
GWTLNSAGYLLGKINLKALAALAKKIL

SEQ ID NO: 404 - protein, 16 aa, Artificial Sequence
  Yeast PRP6 (129 - 144), synthesized
TRRNKRNRIQEQLNRK

SEQ ID NO: 405 - protein, 17 aa, Artificial Sequence
  {Cys58}105Y  Cell Penetrating Peptide  _1 - antitrypsin (358 - 374), synthesized
CSIPPEVKFNKPFVYLI

SEQ ID NO: 406 - protein, 16 aa, Artificial Sequence
  105Y  _1 - antitrypsin (359 - 374), synthesized
SIPPEVKFNKPFVYLI

SEQ ID NO: 407 - protein, 6 aa, Artificial Sequence
  Aminopeptidase N Ligand (CD13)  NGR peptide, synthesized
  DISULFID (1)..(5): Disulfide Bond
CNGRCG

SEQ ID NO: 408 - protein, 17 aa, Artificial Sequence
  Antennapedia Leader Peptide (CT), synthesized
KKWKMRRNQFWVKVQRG

SEQ ID NO: 409 - protein, 16 aa, Artificial Sequence
  Antennapedia Peptide  acid, synthesized
RQIKIWFQNRRMKWKK

SEQ ID NO: 410 - protein, 16 aa, Artificial Sequence
  Antennapedia Peptide  amide, synthesized
  MOD_RES (16)..(16): AMIDATION
RQIKIWFQNRRMKWKK

SEQ ID NO: 411 - protein, 43 aa, Artificial Sequence
  Anti - BetaGamma (MPS - Phosducin - like protein C terminus), synthesized
AAVALLPAVLLALLAVTDQLGEDFFAVDLEAFLQEFGLLPEKE

SEQ ID NO: 412 - protein, 28 aa, Artificial Sequence
  Bcl - 2 Binding Peptide  cell permeable, synthesized
  MISC_FEATURE (1)..(1): Xaa = Noraleucine
XKNLWAAQRYGRELRRMSDEFEGSFKGL

SEQ ID NO: 413 - protein, 19 aa, Artificial Sequence
  Alpha - A - Crystallin (70 - 88), synthesized
KFVIFLDVKHFSPEDLTVK

SEQ ID NO: 414 - protein, 7 aa, Artificial Sequence
  Hsc70 - binding Peptide II, synthesized
NIVRKKK

SEQ ID NO: 415 - protein, 9 aa, Artificial Sequence
  {Thr28  Nle31} - Cholecystokinin (25 - 33), synthesized
  MISC_FEATURE (3)..(3): Xaa = Sulfated Tyrosine
  MISC_FEATURE (7)..(7): Xaa = Noraleucine
  MOD_RES (9)..(9): AMIDATION
RDXTGWXDF

SEQ ID NO: 416 - protein, 10 aa, Artificial Sequence
  Caerulein, synthesized
  MISC_FEATURE (1)..(1): Xaa = Pyroglutamic acid
  MISC_FEATURE (4)..(4): Xaa = Sulfated Tyrosine
  MOD_RES (10)..(10): AMIDATION
XQDXTGWMDF

SEQ ID NO: 417 - protein, 21 aa, Artificial Sequence
  Cholecystokinin (1 - 21), synthesized
KAPSGRVSMIKNLQSLDPSHR

SEQ ID NO: 418 - protein, 11 aa, Artificial Sequence
  Cholecystokinin (10 - 20), synthesized
IKNLQSLDPSH

SEQ ID NO: 419 - protein, 8 aa, Artificial Sequence
  Cholecystokinin (26 - 33)  CCK Octapeptide, synthesized
  MISC_FEATURE (2)..(2): Xaa = Sulfated Tyrosine
  MOD_RES (8)..(8): AMIDATION
DXMGWMDF

SEQ ID NO: 420 - protein, 8 aa, Artificial Sequence [sequence omitted]

SEQ ID NO: 421 - protein, 8 aa, Artificial Sequence [sequence omitted]

SEQ ID NO: 422 - protein, 9 aa, Artificial Sequence
  Cholecystokinin Flanking Peptide, synthesized
SAEEYEYPS

SEQ ID NO: 423 - protein, 7 aa, Artificial Sequence
  Cholecystokinin  CCK (27 - 33), synthesized
  MOD_RES (7)..(7): AMIDATION
YMGWMDF

SEQ ID NO: 424 - protein, 9 aa, Artificial Sequence
  Prepro CCK fragment, synthesized
VPVEAVDPM

SEQ ID NO: 425 - protein, 43 aa, Artificial Sequence
  {Tyr0} - Corticotropin Releasing Factor  {Tyr0}, synthesized
  MOD_RES (43)..(43): AMIDATION
YSEEPPISLDLTFHLLREVLEEMARAEQLAQQAHSNRKLMEII

SEQ ID NO: 426 - protein, 42 aa, Artificial Sequence
  {Tyr0} - Corticotropin Releasing Factor  {Tyr0} sheep, synthesized
  MOD_RES (42)..(42): AMIDATION
YSQEPPISLDLTFHLLREVLEMTKADQLAQQAHSNRKLLDIA

SEQ ID NO: 427 - protein, 41 aa, Rattus norvegicus
  MOD_RES (41)..(41): AMIDATION
SEEPPISLDLTFHLLREVLEMARAEQLAQQAHSNRKLMEII

SEQ ID NO: 428 - protein, 29 aa, Artificial Sequence
  {Tyr0} - Somatostatin 28
  DISULFID (18)..(29): Disulfide Bond
YSANSNPAMAPRERKAGCKNFFWKTFTSC

SEQ ID NO: 429 - protein, 14 aa, Artificial Sequence
  {Tyr1} - Somatostatin 14
  DISULFID (3)..(14): Disulfide Bond
YGCKNFFWKTFTSC

SEQ ID NO: 430 - protein, 38 aa, Artificial Sequence
  Big Endothelin - 1 (1 - 38)
  DISULFID (1)..(15): Disulfide Bond
  DISULFID (3)..(11): Disulfide Bond
CSCSSLMDKECVYFCHLDIIWVNTPEHVVPYGLGSPRS

SEQ ID NO: 431 - protein, 170 aa, homo sapiens
MDTRNKAQLLVLLTLLSVLFSQTSAWPLYRAPSALRLGDRIPFEGANEPDQVSLKEDIDMLQNALAENDTPYYDVSRNARHADGVFTSDFSKLLGQLSAKKYLESLMGKRVSSNISEDPVPVKRHSDAVFTDNYTRLRKQMAVKKYLNSILNGKRSSEGESPDFPEELEK

SEQ ID NO: 432 - protein, 169 aa, homo sapiens
MDTRNKAQLLVLLTLLSVLFSQTSAWPLYRAPSALRLGDRIPFEGANEPDQVSLKEDIDMLQNALAENDTPYYDVSRNARHADGVFTSDFSKLLGQLSAKKYLESLMGKRVSNISEDPVPVKRHSDAVFTDNYTRLRKQMAVKKYLNSILNGKRSSEGESPDFPEELEK

SEQ ID NO: 433 - protein, 31 aa, Artificial Sequence
  VIP Synthetic sequence 1 Bay55-9837
HSDAVFTDNYTRLRKQVAAKKYLQSIKNKRY

SEQ ID NO: 434 - protein, 28 aa, Artificial Sequence
  VIP Synthetic sequence 2
HADAVFTAAYARLRKQMAAKKALAAIAA

SEQ ID NO: 435 - protein, 28 aa, Artificial Sequence
  VIP Synthetic sequence 3
HSDAVFTDNYARLRKQMAVKKALNSILA

SEQ ID NO: 436 - protein, 29 aa, Artificial Sequence
  VIP Synthetic sequence 4
  MOD_RES (1)..(1): ACETYLATION
YFDAIFTNSYRKVLGQLSARKLLQDIMSR

SEQ ID NO: 437 - protein, 23 aa, Artificial Sequence
  VIP Synthetic sequence 5
FTDNYTRLRKQMAVKKYLNSILN

SEQ ID NO: 438 - protein, 28 aa, Artificial Sequence
  VIP Synthetic sequence 6
  MISC_FEATURE (6)..(6): Xaa = d-para-Chloro-Phenylalanine
HSDAVXTDNYTRLRKQLAVKKYLNSILN

SEQ ID NO: 439 - protein, 31 aa, Artificial Sequence; identical to SEQ ID NO: 433
  VIP Synthetic sequence 7 Ac
  MOD_RES (1)..(1): ACETYLATION

SEQ ID NO: 440 - protein, 31 aa, Artificial Sequence
  VIP Synthetic sequence 8
HTDAVFTDNYTRLRKQVAAKKYLQSIKNKRY

SEQ ID NO: 441 - protein, 31 aa, Artificial Sequence
  VIP Synthetic sequence 9
HSEAVFTDNYTRLRKQVAAKKYLQSIKNKRY

SEQ ID NO: 442 - protein, 31 aa, Artificial Sequence
  VIP Synthetic sequence 10
HSDAVFTDQYTRLRKQVAAKKYLQSIKQKRY

SEQ ID NO: 443 - protein, 31 aa, Artificial Sequence
  VIP Synthetic sequence 11
HTEAVFTDNYTRLRKQVAAKKYLQSIKNKRY

SEQ ID NO: 444 - protein, 31 aa, Artificial Sequence
  VIP Synthetic sequence 12
HTDAVFTDQYTRLRKQVAAKKYLQSIKQKRY

SEQ ID NO: 445 - protein, 31 aa, Artificial Sequence; identical to SEQ ID NO: 444
  VIP Synthetic sequence 12 Ac
  MOD_RES (1)..(1): ACETYLATION

SEQ ID NO: 446 - protein, 32 aa, Artificial Sequence
  VIP Synthetic sequence 13
HSDAVFTDNYTRLRKQVAAKKYLQSIKNKRYC

SEQ ID NO: 447 - protein, 32 aa, Artificial Sequence
  VIP Synthetic sequence 14
  MISC_FEATURE (32)..(32): Xaa = Pegalyated Cystine (22kDa)
HSDAVFTDNYTRLRKQVAAKKYLQSIKNKRYX

SEQ ID NO: 448 - protein, 32 aa, Artificial Sequence; identical to SEQ ID NO: 447
  VIP Synthetic sequence 15
  MISC_FEATURE (32)..(32): Xaa = Pegalyated Cystine (43kDa)

SEQ ID NO: 449 - protein, 34 aa, Artificial Sequence
  VIP Synthetic sequence 16
HSDAVFTDNYTRLRKQVAAKKYLQSIKNKRYSWC

SEQ ID NO: 450 - protein, 34 aa, Artificial Sequence
  VIP Synthetic sequence 17
  MISC_FEATURE (34)..(34): Xaa = Pegalyated Cystine (22kDa)
HSDAVFTDNYTRLRKQVAAKKYLQSIKNKRYSWX

SEQ ID NO: 451 - protein, 34 aa, Artificial Sequence; identical to SEQ ID NO: 450
  VIP Synthetic sequence 18
  MISC_FEATURE (34)..(34): Xaa = Pegalyated Cystine (43kDa)

SEQ ID NO: 452 - protein, 32 aa, Artificial Sequence
  VIP Synthetic sequence 19
HSDAVFTDQYTRLRKQVAAKKYLQSIKQKRYC

SEQ ID NO: 453 - protein, 32 aa, Artificial Sequence
  VIP Synthetic sequence 20
  MISC_FEATURE (32)..(32): Xaa = Pegalyated Cystine (22kDa)
HSDAVFTDQYTRLRKQVAAKKYLQSIKQKRYX

SEQ ID NO: 454 - protein, 32 aa, Artificial Sequence; identical to SEQ ID NO: 453
  VIP Synthetic sequence 21
  MISC_FEATURE (32)..(32): Xaa = Pegalyated Cystine (43kDa)

SEQ ID NO: 455 - protein, 33 aa, Artificial Sequence
  VIP Synthetic sequence 22 Ro25-1553 Ac
  MOD_RES (1)..(1): ACETYLATION
  MISC_FEATURE (17)..(17): Xaa = Noraleucine
  MISC_FEATURE (22)..(22): Xaa = Lys - Lys lactam bridge
  MISC_FEATURE (27)..(27): Xaa = Lys - Lys lactam bridge
HSDAVFTENYTKLRKQXAAKKXYLNDXLKKGGT

SEQ ID NO: 456 - protein, 30 aa, Artificial Sequence
  VIP Synthetic sequence 23 Ro25-1392 Ac
  MOD_RES (1)..(1): ACETYLATION
  MISC_FEATURE (10)..(10): Xaa = Methylated Tyrosine
  MISC_FEATURE (17)..(17): Xaa = Noraleucine
  MISC_FEATURE (22)..(22): Xaa = Lys - Lys lactam bridge
  MISC_FEATURE (27)..(27): Xaa = Lys - Lys lactam bridge
HSDAVFTENXTKLRKQXAAKKXYLNDXLKK

SEQ ID NO: 457 - protein, 31 aa, Artificial Sequence
  VIP Synthetic sequence 24
HSDAVFTDNYTRLRRQLAVRRYLNSILNGRR

SEQ ID NO: 458 - protein, 27 aa, Artificial Sequence
  VIP Synthetic sequence 25 Ac
  MOD_RES (1)..(1): ACETYLATION
  MISC_FEATURE (2)..(2): Xaa = d-Phenylalanine
HXDAVFTNSYRKVLKRLSARKLLQDIL

SEQ ID NO: 459 - protein, 26 aa, Artificial Sequence
  VIP Synthetic sequence 26
HSDAVFTNSYRKVLKRLSARKLLQDL

SEQ ID NO: 460 - protein, 27 aa, Artificial Sequence
  VIP Synthetic sequence 27
  MISC_FEATURE (2)..(2): Xaa = D - Alanine
  MOD_RES (8)..(8): Xaa = AIB
  MOD_RES (18)..(18): Xaa = AIB
  MISC_FEATURE (27)..(27): Xaa = Gamma-aminobutyric acid
HXDAIFTXAYRKVLAALXARKALAAAX

SEQ ID NO: 461 - protein, 27 aa, Artificial Sequence
  VIP Synthetic sequence 28
HSDGLFTSEYSKMRGRAQVQKFIQNLM

SEQ ID NO: 462 - protein, 28 aa, Artificial Sequence
  VIP Synthetic sequence 29
  MISC_FEATURE (18)..(18): Xaa = ,-diphenyl-L-alanine
HSDAVFTDYYTRLRKQMXVKKYLNSILN

SEQ ID NO: 463 - protein, 23 aa, Artificial Sequence
  VIP Synthetic sequence 30
  MISC_FEATURE (13)..(13): Xaa = ,-diphenyl-L-alanine
FTDYYTRLRKQMXVKKYLNSILN

SEQ ID NO: 464 - protein, 31 aa, Artificial Sequence
  VIP Synthetic sequence 31
  MISC_FEATURE (12)..(12): Xaa = Methylated Lysine
HSDAVFTDNYTXLRKQMAVKKYLNSIKKGGT

SEQ ID NO: 465 - protein, 27 aa, Artificial Sequence
  VIP Synthetic sequence 32 PG 97-268 Ac
  MOD_RES (1)..(1): ACETYLATION
HSDAVFTNSYRKVLKRLSARKLLQDIL

SEQ ID NO: 466 - protein, 28 aa, Artificial Sequence
  VIP Synthetic sequence 33 Ac
  MOD_RES (1)..(1): ACETYLATION
  MISC_FEATURE (5)..(5): Xaa = D - Arginine
  MISC_FEATURE (26)..(26): Xaa = Noraleucine
  MISC_FEATURE (27)..(27): Xaa = D - Arginine
  MISC_FEATURE (28)..(28): Xaa = Homoarginine
HDAIXTNSYRKVLKRLSAKKYLQDIXXX

SEQ ID NO: 467 - protein, 32 aa, Artificial Sequence
  VIP Synthetic sequence 34 Ac
  MOD_RES (1)..(1): ACETYLATION
  MISC_FEATURE (2)..(2): Xaa = d-Phenylalanine
  MISC_FEATURE (7)..(7): Xaa = d-Tyrosine
  MISC_FEATURE (8)..(8): Xaa = 3 - Mercaptopropionyl Cystine
  MISC_FEATURE (9)..(9): Xaa = Beta-3 homo- Leucine
  MISC_FEATURE (18)..(18): Xaa = Aminobutanoic acid
  MISC_FEATURE (30)..(30): Xaa = Noraleucine
  MISC_FEATURE (31)..(31): Xaa = D - Arginine
  MISC_FEATURE (32)..(32): Xaa = Homoarginine
HXDAIFXXXTNRYRKVLXQLSARKLLQDIXXX

SEQ ID NO: 468 - protein, 31 aa, Artificial Sequence
  VIP synthetic sequence 35
HSDAVFTDQYTRLRKQLAAKKYLQSLKKKRY

SEQ ID NO: 469 - protein, 31 aa, Artificial Sequence
  VIP synthetic sequence 36
HSDAVFTDNYTRLRKQVAAKKYLQSLKNKRY

SEQ ID NO: 470 - protein, 28 aa, Artificial Sequence
  VIP synthetic sequence 37 Hexanoyl
  MISC_FEATURE (1)..(1): Xaa = C6-hexanoyl-Histadine
XSDAVFTDNYTRLRKQMAVKKYLNSILN

SEQ ID NO: 471 - protein, 28 aa, Artificial Sequence
  VIP synthetic sequence 38 Hexanoyl
  MISC_FEATURE (1)..(1): Xaa = C6-hexanoyl-Histadine
XSDAVFTDNYTRLRKQMAAKKYLNSIKK

SEQ ID NO: 472 - protein, 29 aa, Artificial Sequence
  VIP analog 1
  MISC_FEATURE (10)..(10): Xaa = Methylated Tyrosine
  MOD_RES (13)..(13): Xaa = AIB
  MOD_RES (15)..(15): Xaa = AIB
  MOD_RES (20)..(20): Xaa = AIB
  MISC_FEATURE (21)..(21): Xaa = Ornithine
  MISC_FEATURE (22)..(22): Xaa = Methylated Tyrosine
  MOD_RES (28)..(28): Xaa = AIB
  MISC_FEATURE (29)..(29): Xaa = Ornithine
HSDAVFTEQXTRXRXQLAAXXXLQSIKXX

SEQ ID NO: 473 - protein, 28 aa, Artificial Sequence
  VIP analog 2
  MISC_FEATURE (9)..(9): Xaa = epsilon-(3prime-mercaptoproprionyl)-lysine
  MISC_FEATURE (10)..(10): Xaa = Methylated Tyrosine
  MISC_FEATURE (12)..(12): Xaa = Ornithine
  MOD_RES (15)..(15): Xaa = AIB
  MOD_RES (20)..(20): Xaa = AIB
  MISC_FEATURE (21)..(21): Xaa = Ornithine
  MISC_FEATURE (27)..(27): Xaa = Ornithine
  MISC_FEATURE (28)..(28): Xaa = Ornithine
HSDAVFTEXXTXLRXQVAAXXYLQSIXX

SEQ ID NO: 474 - protein, 29 aa, Artificial Sequence
  VIP analog 3
  MISC_FEATURE (10)..(10): Xaa = Methylated Tyrosine
  MISC_FEATURE (12)..(12): Xaa = Ornithine
  MOD_RES (15)..(15): Xaa = AIB
  MOD_RES (20)..(20): Xaa = AIB
  MISC_FEATURE (21)..(21): Xaa = Ornithine
  MISC_FEATURE (27)..(27): Xaa = Ornithine
  MISC_FEATURE (28)..(28): Xaa = epsilon-(L-tryptophyl)-lysine
  MISC_FEATURE (29)..(29): Xaa = Ornithine
HSDAVFTEQXTXLRXQVAAXXYLQSIXXX

SEQ ID NO: 475 - protein, 28 aa, Artificial Sequence
  VIP analog 4
  MISC_FEATURE (10)..(10): Xaa = Methylated Tyrosine
  MISC_FEATURE (12)..(12): Xaa = Ornithine
  MOD_RES (15)..(15): Xaa = AIB
  MOD_RES (20)..(20): Xaa = AIB
  MISC_FEATURE (21)..(21): Xaa = epsilon-(3prime-mercaptoproprionyl)-lysine
  MISC_FEATURE (27)..(27): Xaa = Ornithine
  MISC_FEATURE (28)..(28): Xaa = Ornithine
HSDAVFTEQXTXLRXQVAAXXYLQSIXX

SEQ ID NO: 476 - protein, 28 aa, Artificial Sequence
  VIP analog 5
  MISC_FEATURE (10)..(10): Xaa = Methylated Tyrosine
  MISC_FEATURE (12)..(12): Xaa = Ornithine
  MOD_RES (15)..(15): Xaa = AIB
  MISC_FEATURE (20)..(20): Xaa = epsilon-(3prime-mercaptoproprionyl)-lysine
  MISC_FEATURE (21)..(21): Xaa = Ornithine
  MISC_FEATURE (27)..(27): Xaa = Ornithine
  MISC_FEATURE (28)..(28): Xaa = Ornithine
HSDAVFTEQXTXLRXQVAAXXYLQSIXX

SEQ ID NO: 477 - protein, 28 aa, Artificial Sequence
  VIP analog 6
  MISC_FEATURE (10)..(10): Xaa = Methylated Tyrosine
  MISC_FEATURE (12)..(12): Xaa = Ornithine
  MOD_RES (15)..(15): Xaa = AIB
  MOD_RES (20)..(20): Xaa = AIB
  MISC_FEATURE (21)..(21): Xaa = Ornithine
  MISC_FEATURE (27)..(27): Xaa = Ornithine
  MISC_FEATURE (28)..(28): Xaa = Ornithine
HSDAVFTEQXTXLRXQVCAXXYLQSIXX

SEQ ID NO: 478 - protein, 28 aa, Artificial Sequence
  VIP analog 7
  MISC_FEATURE (10)..(10): Xaa = Methylated Tyrosine
  MISC_FEATURE (12)..(12): Xaa = Ornithine
  MOD_RES (20)..(20): Xaa = AIB
  MISC_FEATURE (21)..(21): Xaa = Ornithine
  MISC_FEATURE (27)..(27): Xaa = Ornithine
  MISC_FEATURE (28)..(28): Xaa = Ornithine
HSDAVFTEQXTXLRCQVAAXXYLQSIXX

SEQ ID NO: 479 - protein, 28 aa, Artificial Sequence
  VIP analog 8
  MISC_FEATURE (10)..(10): Xaa = Methylated Tyrosine
  MISC_FEATURE (12)..(12): Xaa = Ornithine
  MOD_RES (15)..(15): Xaa = AIB
  MOD_RES (20)..(20): Xaa = AIB
  MISC_FEATURE (21)..(21): Xaa = Ornithine
  MISC_FEATURE (27)..(27): Xaa = Ornithine
  MISC_FEATURE (28)..(28): Xaa = Ornithine
HSDAVFTEQXTXLRXQLAAXXYLQSIXX

SEQ ID NO: 480 - protein, 28 aa, Artificial Sequence
  VIP analog 9
  MISC_FEATURE (10)..(10): Xaa = Methylated Tyrosine
  MISC_FEATURE (12)..(12): Xaa = Ornithine
  MOD_RES (15)..(15): Xaa = AIB
  MOD_RES (20)..(20): Xaa = AIB
  MISC_FEATURE (21)..(21): Xaa = Ornithine
  MOD_RES (23)..(23): Xaa = AIB
  MISC_FEATURE (27)..(27): Xaa = Ornithine
  MISC_FEATURE (28)..(28): Xaa = Ornithine
HSDAVFTEQXTXLRXQVAAXXYXQSIXX

SEQ ID NO: 481 - protein, 28 aa, Artificial Sequence
  VIP analog 10
  MISC_FEATURE (10)..(10): Xaa = Methylated Tyrosine
  MISC_FEATURE (12)..(12): Xaa = Ornithine
  MOD_RES (15)..(15): Xaa = AIB
  MOD_RES (20)..(20): Xaa = AIB
  MISC_FEATURE (21)..(21): Xaa = Ornithine
  MOD_RES (25)..(25): Xaa = AIB
  MISC_FEATURE (27)..(27): Xaa = Ornithine
  MISC_FEATURE (28)..(28): Xaa = Ornithine
HSDAVFTEQXTXLRXQVAAXXYLQXIXX

SEQ ID NO: 482 - protein, 28 aa, Artificial Sequence
  VIP analog 11
  MISC_FEATURE (10)..(10): Xaa = Methylated Tyrosine
  MISC_FEATURE (12)..(12): Xaa = Ornithine
  MOD_RES (15)..(15): Xaa = AIB
  MISC_FEATURE (19)..(19): Xaa = Aminobutanoic acid
  MOD_RES (20)..(20): Xaa = AIB
  MISC_FEATURE (21)..(21): Xaa = Ornithine
  MOD_RES (25)..(25): Xaa = AIB
  MISC_FEATURE (27)..(27): Xaa = Ornithine
  MISC_FEATURE (28)..(28): Xaa = Ornithine
HSDAVFTEQXTXLRXQVAXXXYLQXIXX

SEQ ID NO: 483 - protein, 28 aa, Artificial Sequence
  VIP analog 12
  MISC_FEATURE (10)..(10): Xaa = Methylated Tyrosine
  MISC_FEATURE (12)..(12): Xaa = Ornithine
  MOD_RES (15)..(15): Xaa = AIB
  MOD_RES (20)..(20): Xaa = AIB
  MISC_FEATURE (21)..(21): Xaa = Ornithine
  MOD_RES (25)..(25): Xaa = AIB
  MISC_FEATURE (27)..(27): Xaa = Ornithine
  MISC_FEATURE (28)..(28): Xaa = Ornithine
HSDAVFTEQXTXLRXQLAAXXYLQXIXX

SEQ ID NO: 484 - protein, 28 aa, Artificial Sequence
  VIP analog 13
  MISC_FEATURE (10)..(10): Xaa = Methylated Tyrosine
  MISC_FEATURE (12)..(12): Xaa = Ornithine
  MOD_RES (15)..(15): Xaa = AIB
  MOD_RES (20)..(20): Xaa = AIB
  MISC_FEATURE (21)..(21): Xaa = Ornithine
  MOD_RES (23)..(23): Xaa = AIB
  MOD_RES (25)..(25): Xaa = AIB
  MISC_FEATURE (27)..(27): Xaa = Ornithine
  MISC_FEATURE (28)..(28): Xaa = Ornithine
HSDAVFTEQXTXLRXQLAAXXYXQXIXX

SEQ ID NO: 485 - protein, 28 aa, Artificial Sequence
  VIP analog 14
  MISC_FEATURE (10)..(10): Xaa = Methylated Tyrosine
  MISC_FEATURE (12)..(12): Xaa = Ornithine
  MOD_RES (15)..(15): Xaa = AIB
  MISC_FEATURE (19)..(19): Xaa = Aminobutanoic acid
  MOD_RES (20)..(20): Xaa = AIB
  MISC_FEATURE (21)..(21): Xaa = Ornithine
  MOD_RES (23)..(23): Xaa = AIB
  MISC_FEATURE (27)..(27): Xaa = Ornithine
  MISC_FEATURE (28)..(28): Xaa = Ornithine
HSDAVFTEQXTXLRXQLAXXXYXQSIXX

SEQ ID NO: 486 - protein, 28 aa, Artificial Sequence
  VIP analog 15
  MISC_FEATURE (10)..(10): Xaa = Methylated Tyrosine
  MISC_FEATURE (12)..(12): Xaa = Ornithine
  MOD_RES (15)..(15): Xaa = AIB
  MISC_FEATURE (19)..(19): Xaa = Aminobutanoic acid
  MOD_RES (20)..(20): Xaa = AIB
  MISC_FEATURE (21)..(21): Xaa = Ornithine
  MISC_FEATURE (27)..(27): Xaa = Ornithine
  MISC_FEATURE (28)..(28): Xaa = Ornithine
HSDAVFTEQXTXLRXQLAXXXYLQSIXX

SEQ ID NO: 487 - protein, 28 aa, Artificial Sequence
  VIP analog 16
  MISC_FEATURE (10)..(10): Xaa = Methylated Tyrosine
  MISC_FEATURE (12)..(12): Xaa = Ornithine
  MOD_RES (15)..(15): Xaa = AIB
  MISC_FEATURE (19)..(19): Xaa = Aminobutanoic acid
  MOD_RES (20)..(20): Xaa = AIB
  MISC_FEATURE (21)..(21): Xaa = Ornithine
  MOD_RES (23)..(23): Xaa = AIB
  MOD_RES (25)..(25): Xaa = AIB
  MISC_FEATURE (27)..(27): Xaa = Ornithine
  MISC_FEATURE (28)..(28): Xaa = Ornithine
HSDAVFTEQXTXLRXQLAXXXYXQXIXX

SEQ ID NO: 488 - protein, 28 aa, Artificial Sequence
  VIP analog 17
  MISC_FEATURE (10)..(10): Xaa = Methylated Tyrosine
  MISC_FEATURE (12)..(12): Xaa = Ornithine
  MOD_RES (15)..(15): Xaa = AIB
  MOD_RES (20)..(20): Xaa = AIB
  MISC_FEATURE (21)..(21): Xaa = Ornithine
  MOD_RES (23)..(23): Xaa = AIB
  MISC_FEATURE (27)..(27): Xaa = Ornithine
  MISC_FEATURE (28)..(28): Xaa = Ornithine
HSDAVFTEQXTXLRXQLAAXXYXQSIXX

SEQ ID NO: 489 - protein, 28 aa, Artificial Sequence
  VIP analog 18
  MISC_FEATURE (10)..(10): Xaa = Methylated Tyrosine
  MISC_FEATURE (12)..(12): Xaa = Ornithine
  MISC_FEATURE (15)..(15): Xaa = epsilon-(L-tryptophyl)-lysine
  MOD_RES (20)..(20): Xaa = AIB
  MISC_FEATURE (21)..(21): Xaa = Ornithine
  MISC_FEATURE (27)..(27): Xaa = Ornithine
  MISC_FEATURE (28)..(28): Xaa = Ornithine
HSDAVFTEQXTXLRXQVAAXXYLQSIXX

SEQ ID NO: 490 - protein, 28 aa, Artificial Sequence
  VIP analog 19
  MISC_FEATURE (10)..(10): Xaa = Methylated Tyrosine
  MISC_FEATURE (12)..(12): Xaa = Ornithine
  MOD_RES (15)..(15): Xaa = AIB
  MOD_RES (20)..(20): Xaa = AIB
  MISC_FEATURE (21)..(21): Xaa = Ornithine
  MISC_FEATURE (24)..(24): Xaa = epsilon-(L-tryptophyl)-lysine
  MISC_FEATURE (27)..(27): Xaa = Ornithine
  MISC_FEATURE (28)..(28): Xaa = Ornithine
HSDAVFTEQXTXLRXQVAAXXYLXSIXX

SEQ ID NO: 491 - protein, 28 aa, Artificial Sequence
  VIP analog 20
  MISC_FEATURE (10)..(10): Xaa = Methylated Tyrosine
  MISC_FEATURE (12)..(12): Xaa = Ornithine
  MOD_RES (15)..(15): Xaa = AIB
  MISC_FEATURE (17)..(17): Xaa = epsilon-(L-tryptophyl)-lysine
  MOD_RES (20)..(20): Xaa = AIB
  MISC_FEATURE (21)..(21): Xaa = Ornithine
  MISC_FEATURE (27)..(27): Xaa = Ornithine
  MISC_FEATURE (28)..(28): Xaa = Ornithine
HSDAVFTEQXTXLRXQXAAXXYLQSIXX

SEQ ID NO: 492 - protein, 28 aa, Artificial Sequence
  VIP analog 21
  MISC_FEATURE (10)..(10): Xaa = Methylated Tyrosine
  MISC_FEATURE (12)..(12): Xaa = Ornithine
  MISC_FEATURE (15)..(15): Xaa = epsilon-(3prime-mercaptoproprionyl)-lysine
  MOD_RES (20)..(20): Xaa = AIB
  MISC_FEATURE (21)..(21): Xaa = Ornithine
  MISC_FEATURE (27)..(27): Xaa = Ornithine
  MISC_FEATURE (28)..(28): Xaa = Ornithine
HSDAVFTEQXTXLRXQVAAXXYLQSIXX

SEQ ID NO: 493 - protein, 28 aa, Artificial Sequence
  VIP analog 22
  MISC_FEATURE (10)..(10): Xaa = Methylated Tyrosine
  MISC_FEATURE (12)..(12): Xaa = Ornithine
  MOD_RES (15)..(15): Xaa = AIB
  MOD_RES (20)..(20): Xaa = AIB
  MISC_FEATURE (21)..(21): Xaa = epsilon-(L-tryptophyl)-lysine
  MISC_FEATURE (27)..(27): Xaa = Ornithine
  MISC_FEATURE (28)..(28): Xaa = Ornithine
HSDAVFTEQXTXLRXQVAAXXYLQSIXX

SEQ ID NO: 494 - protein, 28 aa, Artificial Sequence
  VIP analog 23
  MISC_FEATURE (10)..(10): Xaa = Methylated Tyrosine
  MISC_FEATURE (12)..(12): Xaa = Ornithine
  MOD_RES (15)..(15): Xaa = AIB
  MOD_RES (20)..(20): Xaa = AIB
  MISC_FEATURE (27)..(27): Xaa = Ornithine
  MISC_FEATURE (28)..(28): Xaa = Ornithine
HSDAVFTEQXTXLRXQVAAXCYLQSIXX

SEQ ID NO: 495 - protein, 28 aa, Artificial Sequence
  VIP analog 24
  MISC_FEATURE (10)..(10): Xaa = Methylated Tyrosine
  MISC_FEATURE (12)..(12): Xaa = Ornithine
  MOD_RES (15)..(15): Xaa = AIB
  MISC_FEATURE (19)..(19): Xaa = Aminobutanoic acid
  MOD_RES (20)..(20): Xaa = AIB
  MISC_FEATURE (21)..(21): Xaa = Ornithine
  MOD_RES (25)..(25): Xaa = AIB
  MISC_FEATURE (27)..(27): Xaa = Ornithine
  MISC_FEATURE (28)..(28): Xaa = Ornithine
HSDAVFTEQXTXLRXQLAXXXYLQXIXX

SEQ ID NO: 496 - protein, 28 aa, Artificial Sequence
  VIP analog 25
  MISC_FEATURE (10)..(10): Xaa = Methylated Tyrosine
  MISC_FEATURE (12)..(12): Xaa = Ornithine
  MOD_RES (15)..(15): Xaa = AIB
  MOD_RES (20)..(20): Xaa = AIB
  MISC_FEATURE (21)..(21): Xaa = Ornithine
  MISC_FEATURE (26)..(26): Xaa = epsilon-(L-tryptophyl)-lysine
  MISC_FEATURE (27)..(27): Xaa = Ornithine
  MISC_FEATURE (28)..(28): Xaa = Ornithine
HSDAVFTEQXTXLRXQVAAXXYLQSXXX

SEQ ID NO: 497 - protein, 29 aa, Artificial Sequence
  VIP analog 26
  MISC_FEATURE (10)..(10): Xaa = Methylated Tyrosine
  MISC_FEATURE (12)..(12): Xaa = Ornithine
  MOD_RES (15)..(15): Xaa = AIB
  MISC_FEATURE (19)..(19): Xaa = Aminobutanoic acid
  MOD_RES (20)..(20): Xaa = AIB
  MISC_FEATURE (21)..(21): Xaa = Ornithine
  MOD_RES (25)..(25): Xaa = AIB
  MISC_FEATURE (27)..(27): Xaa = Ornithine
  MISC_FEATURE (29)..(29): Xaa = Ornithine
HSDAVFTEQXTXLRXQLAXXXYLQXIXCX

SEQ ID NO: 498 - protein, 28 aa, Artificial Sequence
  VIP analog 27
  MISC_FEATURE (10)..(10): Xaa = Methylated Tyrosine
  MISC_FEATURE (12)..(12): Xaa = Ornithine
  MOD_RES (15)..(15): Xaa = AIB
  MISC_FEATURE (19)..(19): Xaa = Aminobutanoic acid
  MOD_RES (20)..(20): Xaa = AIB
  MISC_FEATURE (21)..(21): Xaa = Ornithine
  MOD_RES (25)..(25): Xaa = AIB
  MISC_FEATURE (27)..(27): Xaa = Ornithine
  MISC_FEATURE (28)..(28): Xaa = Ornithine
HSDAVFTEQXTXLRXQLAXXXYLQXCXX

SEQ ID NO: 499 - protein, 28 aa, Artificial Sequence
  VIP analog 28
  MISC_FEATURE (10)..(10): Xaa = Methylated Tyrosine
  MISC_FEATURE (12)..(12): Xaa = Ornithine
  MOD_RES (15)..(15): Xaa = AIB
  MISC_FEATURE (19)..(19): Xaa = Aminobutanoic acid
  MOD_RES (20)..(20): Xaa = AIB
  MISC_FEATURE (21)..(21): Xaa = Ornithine
  MOD_RES (25)..(25): Xaa = AIB
  MISC_FEATURE (27)..(27): Xaa = Ornithine
  MISC_FEATURE (28)..(28): Xaa = Ornithine
HSDAVFTEQXTXLRXQCAXXXYLQXIXX

SEQ ID NO: 500 - protein, 28 aa, Artificial Sequence
  VIP analog 29
  MISC_FEATURE (10)..(10): Xaa = Methylated Tyrosine
  MISC_FEATURE (12)..(12): Xaa = Ornithine
  MISC_FEATURE (19)..(19): Xaa = Aminobutanoic acid
  MOD_RES (20)..(20): Xaa = AIB
  MISC_FEATURE (21)..(21): Xaa = Ornithine
  MOD_RES (25)..(25): Xaa = AIB
  MISC_FEATURE (27)..(27): Xaa = Ornithine
  MISC_FEATURE (28)..(28): Xaa = Ornithine
HSDAVFTEQXTXLRCQLAXXXYLQXIXX

SEQ ID NO: 501 - protein, 28 aa, Artificial Sequence
  VIP analog 30
  MISC_FEATURE (10)..(10): Xaa = Methylated Tyrosine
  MISC_FEATURE (12)..(12): Xaa = Ornithine
  MOD_RES (15)..(15): Xaa = AIB
  MISC_FEATURE (18)..(18): Xaa = epsilon-(3prime-mercaptoproprionyl)-lysine
  MOD_RES (20)..(20): Xaa = AIB
  MISC_FEATURE (21)..(21): Xaa = Ornithine
  MISC_FEATURE (27)..(27): Xaa = Ornithine
  MISC_FEATURE (28)..(28): Xaa = Ornithine
HSDAVFTEQXTXLRXQVXAXXYLQSIXX

SEQ ID NO: 502 - protein, 29 aa, Artificial Sequence
  VIP analog 31
  MISC_FEATURE (10)..(10): Xaa = Methylated Tyrosine
  MISC_FEATURE (12)..(12): Xaa = Ornithine
  MOD_RES (15)..(15): Xaa = AIB
  MISC_FEATURE (19)..(19): Xaa = Aminobutanoic acid
  MOD_RES (20)..(20): Xaa = AIB
  MISC_FEATURE (21)..(21): Xaa = Ornithine
  MISC_FEATURE (27)..(27): Xaa = Ornithine
  MISC_FEATURE (29)..(29): Xaa = Ornithine
HSDAVFTEQXTXLRXQLAXXXYLQSIXCX

SEQ ID NO: 503 - protein, 28 aa, Artificial Sequence
  VIP analog 32
  MISC_FEATURE (10)..(10): Xaa = Methylated Tyrosine
  MISC_FEATURE (12)..(12): Xaa = Ornithine
  MOD_RES (15)..(15): Xaa = AIB
  MISC_FEATURE (19)..(19): Xaa = Aminobutanoic acid
  MOD_RES (20)..(20): Xaa = AIB
  MISC_FEATURE (21)..(21): Xaa = Ornithine
  MISC_FEATURE (27)..(27): Xaa = Ornithine
  MISC_FEATURE (28)..(28): Xaa = Ornithine
HSDAVFTEQXTXLRXQLAXXXYLQSCXX

SEQ ID NO: 504 - protein, 29 aa, Artificial Sequence
  VIP analog 33
  MISC_FEATURE (10)..(10): Xaa = Methylated Tyrosine
  MISC_FEATURE (12)..(12): Xaa = Ornithine
  MOD_RES (15)..(15): Xaa = AIB
  MISC_FEATURE (19)..(19): Xaa = Aminobutanoic acid
  MOD_RES (20)..(20): Xaa = AIB
  MISC_FEATURE (21)..(21): Xaa = Ornithine
  MOD_RES (25)..(25): Xaa = AIB
  MISC_FEATURE (27)..(27): Xaa = Ornithine
  MISC_FEATURE (28)..(28): Xaa = epsilon-(3prime-mercaptoproprionyl)-lysine
  MISC_FEATURE (29)..(29): Xaa = Ornithine
HSDAVFTEQXTXLRXQLAXXXYLQXIXXX

SEQ ID NO: 505 - protein, 29 aa, Artificial Sequence
  VIP analog 34
  MISC_FEATURE (10)..(10): Xaa = Methylated Tyrosine
  MISC_FEATURE (12)..(12): Xaa = Ornithine
  MOD_RES (15)..(15): Xaa = AIB
  MISC_FEATURE (19)..(19): Xaa = Aminobutanoic acid
  MOD_RES (20)..(20): Xaa = AIB
  MISC_FEATURE (21)..(21): Xaa = Ornithine
  MISC_FEATURE (27)..(27): Xaa = Ornithine
  MISC_FEATURE (28)..(28): Xaa = epsilon-(3prime-mercaptoproprionyl)-lysine
  MISC_FEATURE (29)..(29): Xaa = Ornithine
HSDAVFTEQXTXLRXQLAXXXYLQSIXXX

SEQ ID NO: 506 - protein, 28 aa, Artificial Sequence
  VIP analog 35
  MISC_FEATURE (10)..(10): Xaa = Methylated Tyrosine
  MISC_FEATURE (12)..(12): Xaa = Ornithine
  MISC_FEATURE (15)..(15): Xaa = epsilon-(L-tryptophyl)-lysine
  MISC_FEATURE (19)..(19): Xaa = Aminobutanoic acid
  MOD_RES (20)..(20): Xaa = AIB
  MISC_FEATURE (21)..(21): Xaa = Ornithine
  MOD_RES (25)..(25): Xaa = AIB
  MISC_FEATURE (27)..(27): Xaa = Ornithine
  MISC_FEATURE (28)..(28): Xaa = Ornithine
HSDAVFTEQXTXLRXQLAXXXYLQXIXX

SEQ ID NO: 507 - protein, 29 aa, Artificial Sequence
  VIP analog 36
  MISC_FEATURE (10)..(10): Xaa = Methylated Tyrosine
  MISC_FEATURE (12)..(12): Xaa = Ornithine
  MOD_RES (15)..(15): Xaa = AIB
  MOD_RES (20)..(20): Xaa = AIB
  MISC_FEATURE (21)..(21): Xaa = Ornithine
  MISC_FEATURE (27)..(27): Xaa = Ornithine
  MISC_FEATURE (28)..(28): Xaa = Ornithine
HSDAVFTEQXTXLRXQLAAXXYLQSIXXC

SEQ ID NO: 508 - protein, 29 aa, Artificial Sequence
  VIP analog 36
  MISC_FEATURE (10)..(10): Xaa = Methylated Tyrosine
  MISC_FEATURE (12)..(12): Xaa = Ornithine
  MOD_RES (15)..(15): Xaa = AIB
  MOD_RES (20)..(20): Xaa = AIB
  MISC_FEATURE (21)..(21): Xaa = Ornithine
  MISC_FEATURE (27)..(27): Xaa = Ornithine
  MISC_FEATURE (28)..(28): Xaa = Ornithine
HSDAVFTEQXTXLRXQVAAXXYLQSIXXC

SEQ ID NO: 509 - protein, 29 aa, Artificial Sequence
  VIP analog 37
  MISC_FEATURE (10)..(10): Xaa = Methylated Tyrosine
  MISC_FEATURE (12)..(12): Xaa = Ornithine
  MOD_RES (15)..(15): Xaa = AIB
  MISC_FEATURE (19)..(19): Xaa = Aminobutanoic acid
  MOD_RES (20)..(20): Xaa = AIB
  MISC_FEATURE (21)..(21): Xaa = Ornithine
  MISC_FEATURE (27)..(27): Xaa = Ornithine
  MISC_FEATURE (28)..(28): Xaa = Ornithine
HSDAVFTEQXTXLRXQLAXXXYLQSIXXC

SEQ ID NO: 510 - protein, 28 aa, Artificial Sequence
  VIP analog 38
  MISC_FEATURE (10)..(10): Xaa = Methylated Tyrosine
  MISC_FEATURE (12)..(12): Xaa = Ornithine
  MOD_RES (15)..(15): Xaa = AIB
  MISC_FEATURE (19)..(19): Xaa = Aminobutanoic acid
  MOD_RES (20)..(20): Xaa = AIB
  MISC_FEATURE (21)..(21): Xaa = Ornithine
  MISC_FEATURE (22)..(22): Xaa = Methylated Tyrosine
  MOD_RES (25)..(25): Xaa = AIB
  MISC_FEATURE (27)..(27): Xaa = Ornithine
  MISC_FEATURE (28)..(28): Xaa = Ornithine
HSDAVFTEQXTXLRXQLAXXXXLQXIXX

SEQ ID NO: 511 - protein, 29 aa, Artificial Sequence
  VIP analog 39
  MISC_FEATURE (10)..(10): Xaa = Methylated Tyrosine
  MISC_FEATURE (12)..(12): Xaa = Ornithine
  MOD_RES (15)..(15): Xaa = AIB
  MISC_FEATURE (19)..(19): Xaa = Aminobutanoic acid
  MOD_RES (20)..(20): Xaa = AIB
  MISC_FEATURE (21)..(21): Xaa = Ornithine
  MISC_FEATURE (22)..(22): Xaa = Methylated Tyrosine
  MOD_RES (25)..(25): Xaa = AIB
  MISC_FEATURE (27)..(27): Xaa = Ornithine
  MISC_FEATURE (29)..(29): Xaa = Ornithine
HSDAVFTEQXTXLRXQLAXXXXLQXIXCX

SEQ ID NO: 512 - protein, 28 aa, Artificial Sequence
  VIP analog 40
  MISC_FEATURE (10)..(10): Xaa = Methylated Tyrosine
  MISC_FEATURE (12)..(12): Xaa = Ornithine
  MOD_RES (15)..(15): Xaa = AIB
  MISC_FEATURE (19)..(19): Xaa = Aminobutanoic acid
  MOD_RES (20)..(20): Xaa = AIB
  MISC_FEATURE (21)..(21): Xaa = Ornithine
  MISC_FEATURE (22)..(22): Xaa = Methylated Tyrosine
  MOD_RES (25)..(25): Xaa = AIB
  MISC_FEATURE (27)..(27): Xaa = Ornithine
  MISC_FEATURE (28)..(28): Xaa = Ornithine
HSDAVFTEQXTXLRXQCAXXXXLQXIXX

SEQ ID NO: 513 - protein, 29 aa, Artificial Sequence
  VIP analog 41
  MISC_FEATURE (10)..(10): Xaa = Methylated Tyrosine
  MISC_FEATURE (12)..(12): Xaa = Ornithine
  MOD_RES (15)..(15): Xaa = AIB
  MISC_FEATURE (19)..(19): Xaa = Aminobutanoic acid
  MOD_RES (20)..(20): Xaa = AIB
  MISC_FEATURE (21)..(21): Xaa = Ornithine
  MOD_RES (25)..(25): Xaa = AIB
  MISC_FEATURE (27)..(27): Xaa = Ornithine
  MISC_FEATURE (28)..(28): Xaa = Ornithine
HSDAVFTEQXTXLRXQLAXXXYLQXIXXC

SEQ ID NO: 514 - protein, 28 aa, Artificial Sequence
  VIP analog 42
  MISC_FEATURE (10)..(10): Xaa = Methylated Tyrosine
  MISC_FEATURE (12)..(12): Xaa = Ornithine
  MOD_RES (15)..(15): Xaa = AIB
  MISC_FEATURE (19)..(19): Xaa = Aminobutanoic acid
  MOD_RES (20)..(20): Xaa = AIB
  MISC_FEATURE (21)..(21): Xaa = Ornithine
  MISC_FEATURE (22)..(22): Xaa = Methylated Tyrosine
  MISC_FEATURE (27)..(27): Xaa = Ornithine
  MISC_FEATURE (28)..(28): Xaa = Ornithine
HSDAVFTEQXTXLRXQLAXXXXLQSIXX

SEQ ID NO: 515 - protein, 28 aa, Artificial Sequence
  VIP analog 43
  MISC_FEATURE (10)..(10): Xaa = Methylated Tyrosine
  MISC_FEATURE (12)..(12): Xaa = Ornithine
  MOD_RES (15)..(15): Xaa = AIB
  MISC_FEATURE (19)..(19): Xaa = Aminobutanoic acid
  MOD_RES (20)..(20): Xaa = AIB
  MISC_FEATURE (21)..(21): Xaa = Ornithine
  MISC_FEATURE (22)..(22): Xaa = Methylated Tyrosine
  MISC_FEATURE (27)..(27): Xaa = Ornithine
  MISC_FEATURE (28)..(28): Xaa = Ornithine
HSDAVFTEQXTXLRXQCAXXXXLQSIXX

SEQ ID NO: 516 - protein, 29 aa, Artificial Sequence
  VIP analog 44
  MISC_FEATURE (10)..(10): Xaa = Methylated Tyrosine
  MISC_FEATURE (12)..(12): Xaa = Ornithine
  MOD_RES (15)..(15): Xaa = AIB
  MISC_FEATURE (19)..(19): Xaa = Aminobutanoic acid
  MOD_RES (20)..(20): Xaa = AIB
  MISC_FEATURE (21)..(21): Xaa = Ornithine
  MISC_FEATURE (22)..(22): Xaa = Methylated Tyrosine
  MISC_FEATURE (27)..(27): Xaa = Ornithine
  MISC_FEATURE (29)..(29): Xaa = Ornithine
HSDAVFTEQXTXLRXQLAXXXXLQSIXCX

SEQ ID NO: 517 - protein, 28 aa, Artificial Sequence
  VIP analog 45
  MISC_FEATURE (10)..(10): Xaa = Methylated Tyrosine
  MISC_FEATURE (12)..(12): Xaa = Ornithine
  MOD_RES (15)..(15): Xaa = AIB
  MISC_FEATURE (18)..(18): Xaa = Aminobutanoic acid
  MOD_RES (20)..(20): Xaa = AIB
  MISC_FEATURE (21)..(21): Xaa = Ornithine
  MISC_FEATURE (27)..(27): Xaa = Ornithine
  MISC_FEATURE (28)..(28): Xaa = Ornithine
HSDAVFTEQXTXLRXQLXAXXYLQSIXX

SEQ ID NO: 518 - protein, 28 aa, Artificial Sequence
  VIP analog 46
  MISC_FEATURE (10)..(10): Xaa = Methylated Tyrosine
  MISC_FEATURE (12)..(12): Xaa = Ornithine
  MOD_RES (15)..(15): Xaa = AIB
  MISC_FEATURE (17)..(17): Xaa = epsilon-(3prime-mercaptoproprionyl)-lysine
  MISC_FEATURE (19)..(19): Xaa = Aminobutanoic acid
  MOD_RES (20)..(20): Xaa = AIB
  MISC_FEATURE (21)..(21): Xaa = Ornithine
  MOD_RES (25)..(25): Xaa = AIB
  MISC_FEATURE (27)..(27): Xaa = Ornithine
  MISC_FEATURE (28)..(28): Xaa = Ornithine
HSDAVFTEQXTXLRXQXAXXXYLQXIXX

SEQ ID NO: 519 - protein, 28 aa, Artificial Sequence
  VIP analog 47
  MISC_FEATURE (10)..(10): Xaa = Methylated Tyrosine
  MISC_FEATURE (12)..(12): Xaa = Ornithine
  MOD_RES (15)..(15): Xaa = AIB
  MISC_FEATURE (17)..(17): Xaa = epsilon-(L-tryptophyl)-lysine
  MISC_FEATURE (19)..(19): Xaa = Aminobutanoic acid
  MOD_RES (20)..(20): Xaa = AIB
  MISC_FEATURE (21)..(21): Xaa = Ornithine
  MOD_RES (25)..(25): Xaa = AIB
  MISC_FEATURE (27)..(27): Xaa = Ornithine
  MISC_FEATURE (28)..(28): Xaa = Ornithine
HSDAVFTEQXTXLRXQXAXXXYLQXIXX

SEQ ID NO: 520 - protein, 176 aa, homo sapiens
MTMCSGARLALLVYGIIMHSSVYSSPAAAGLRFPGIRPEEEAYGEDGNPLPDFDGSEPPGAGSPASAPRAAAAWYRPAGRRDVAHGILNEAYRKVLDQLSAGKHLQSLVARGVGGSLGGGAGDDAEPLSKRHSDGIFTDSYSRYRKQMAVKKYLAAVLGKRYKQRVKNKGRRIAYL

SEQ ID NO: 521 - protein, 176 aa, homo sapiens; identical to SEQ ID NO: 520

SEQ ID NO: 522 - protein, 33 aa, Artificial Sequence
  PACAP - Antagonist
FTDSYSRYRKQMAVKKYLAAVLGKRYKQRVKNK

SEQ ID NO: 523 - protein, 61 aa, Artificial Sequence [sequence omitted]

SEQ ID NO: 524 - protein, 63 aa, Artificial Sequence
  Maxadilan peptide 2
CDATCQFRKAIDDCQKQAHHSNVLQTSVQTTATFTSMDTSQLPGNSVFKECMKQKKKEFSSGK

SEQ ID NO: 525 - protein, 43 aa, Artificial Sequence
  M65 peptide
CDATCQFRKAIDDCQKQAHHSNVLPGNSVFKECMKQKKKEFKA

SEQ ID NO: 526 - protein, 42 aa, Artificial Sequence
  M65 peptide v2
CDATCQFRKAIDDCQKQAHHSNVLGNSVFKECMKQKKKEFKA

SEQ ID NO: 527 - protein, 46 aa, Artificial Sequence
  M65 peptide v3
GSCDATCQFRKAIDDCQKQAHHSNVPGNSVFKECMKQKKKEFKAGK

SEQ ID NO: 528 - protein, 180 aa, homo sapiens
MKSIYFVAGLFVMLVQGSWQRSLQDTEEKSRSFSASQADPLSDPDQMNEDKRHSQGTFTSDYSKYLDSRRAQDFVQWLMNTKRNRNNIAKRHDEFERHAEGTFTSDVSSYLEGQAAKEFIAWLVKGRGRRDFPEEVAIVEELGRRHADGSFSDEMNTILDNLAARDFINWLIQTKITDRK

SEQ ID NO: 529 - protein, 30 aa, Artificial Sequence
  Glicentin Residues 21-50
RSLQDTEEKSRSFSASQADPLSDPDQMNED

SEQ ID NO: 530 - protein, 37 aa, Artificial Sequence
  Pro GLP-1 Residues 92 - 128
HDEFERHAEGTFTSDVSSYLEGQAAKEFIAWLVKGRG

SEQ ID NO: 531 - protein, 31 aa, Artificial Sequence
  GLP-1 Residues 98 - 128
HAEGTFTSDVSSYLEGQAAKEFIAWLVKGRG

SEQ ID NO: 532 - protein, 33 aa, Artificial Sequence
  GLP-2 Residues 146 - 178
HADGSFSDEMNTILDNLAARDFINWLIQTKITD

SEQ ID NO: 533 - protein, 18 aa, Artificial Sequence
  Apolipoprotein-mimetic peptide  D4F
DWFKAFYDKVAEKFKEAF

SEQ ID NO: 534 - protein, 18 aa, Artificial Sequence
  Apolipoprotein-mimetic peptide
  MOD_RES (1)..(1): ACETYLATION
  MOD_RES (18)..(18): AMIDATION
DKWKAVYDKFAEAFKEFL

SEQ ID NO: 535 - protein, 18 aa, Artificial Sequence
  Apolipoprotein-mimetic peptide
  MOD_RES (1)..(1): ACETYLATION
  MOD_RES (18)..(18): AMIDATION
DWLKAFYDKVAEKFKEAF

SEQ ID NO: 536 - protein, 267 aa, homo sapiens
MKAAVLTLAVLFLTGSQARHFWQQDEPPQSPWDRVKDLATVYVDVLKDSGRDYVSQFEGSALGKQLNLKLLDNWDSVTSTFSKLREQLGPVTQEFWDNLEKETEGLRQEMSKDLEEVKAKVQPYLDDFQKKWQEEMELYRQKVEPLRAELQEGARQKLHELQEKLSPLGEEMRDRARAHVDALRTHLAPYSDELRQRLAARLEALKENGGARLAEYHAKATEHLSTLSEKAKPALEDLRQGLLPVLESFKVSFLSALEEYTKKLNTQ

SEQ ID NO: 537 - protein, 317 aa, homo sapiens [sequence omitted]

SEQ ID NO: 538 - protein, 83 aa, homo sapiens
MRLFLSLPVLVVVLSIVLEGPAPAQGTPDVSSALDKLKEFGNTLEDKARELISRIKQSELSAKMREWFSETFQKVKEKLKIDS

SEQ ID NO: 539 - protein, 76 aa, homo sapiens
CSTNNPSQAKLRRELDESLQVAERLTRKYNELLKSYQWKMLNTSSLLEQLNEQFNWVSRLANLTQGEDQYYLRVTT

SEQ ID NO: 540 - protein, 151 aa, homo sapiens
MSSFSTTTVSFLLLLAFQLLGQTRANPMYNAVSNADLMDFKNLLDHLEEKMPLEDEVVPPQVLSEPNEEAGAALSPLPEVPPWTGEVSPAQRDGGALGRGPWDSSDRSALLKSKLRALLTAPRSLRRSSCFGGRMDRIGAQSGLGCNSFRY

SEQ ID NO: 541 - protein, 24 aa, Artificial Sequence
  ANP Active form 1
RSLRRSSCFGGRMDRIGAQSGLGC

SEQ ID NO: 542 - protein, 29 aa, Artificial Sequence
  ANP Active form 2
RSLRRSSCFGGRMDRIGAQSGLGCNSFRY

SEQ ID NO: 543 - protein, 28 aa, Artificial Sequence
  ANP Active form 3
SLRRSSCFGGRMDRIGAQSGLGCNSFRY

SEQ ID NO: 544 - protein, 67 aa, homo sapiens
NPMYNAVSNADLMDFKNLLDHLEEKMPLEDEVVPPQVLSEPNEEAGAALSPLPEVPPWTGEVSPAQR

SEQ ID NO: 545 - protein, 134 aa, homo sapiens
MDPQTAPSRALLLLLFLHLAFLGGRSHPLGSPGSASDLETSGLQEQRNHLQGKLSELQVEQTSLEPLQESPRPTGVWKSREVATEGIRGHRKMVLYTLRAPRSPKMVQGSGCFGRKMDRISSSSGLGCKVLRRH

SEQ ID NO: 546 - protein, 32 aa, homo sapiens
SPKMVQGSGCFGRKMDRISSSSGLGCKVLRRH

SEQ ID NO: 547 - protein, 126 aa, homo sapiens
MHLSQLLACALLLTLLSLRPSEAKPGAPPKVPRTPPAEELAEPQAAGGGQKKGDKAPGGGGANLKGDRSRLLRDLRVDTKSRAAWARLLQEHPNARKYKGANKKGLSKGCFGLKLDRIGSMSGLGC

SEQ ID NO: 548 - protein, 22 aa, homo sapiens
  DISULFID (6)..(6): Disulfide Bond
GLSKGCFGLKLDRIGSMSGLGC

SEQ ID NO: 549 - protein, 32 aa, homo sapiens
TAPRSLRRSSCFGGRMDRIGAQSGLGCNSFRY

SEQ ID NO: 550 - protein, 32 aa, Artificial Sequence
  Urodilatin 1
RPATSLRRSSCFGGRMDRIGAQSGLGCNSFRY

SEQ ID NO: 551 - protein, 62 aa, Artificial Sequence
  neuropeptide Y preproprotein 1
MLGNKRLGLSGLTLALSLLVCLGALAEAYPSKPDNPGEDAPAEDMARYYSALRHYINLITRQ

SEQ ID NO: 552 - protein, 9 aa, Artificial Sequence
  neuropeptide Y preproprotein 2
QRYGKRSSP

SEQ ID NO: 553 - protein, 27 aa, Artificial Sequence
  neuropeptide Y preproprotein 3
ETLISDLLMRESTENVPRTRLEDPAMW

SEQ ID NO: 554 - protein, 36 aa, Oryctolagus cuniculus
YPSKPDNPGEDAPAEDMARYYSALRHYINLITRQRY

SEQ ID NO: 555 - protein, 62 aa, Artificial Sequence
  peptide YY precursor 1
MVFVRRPWPALTTVLLALLVCLGALVDAYPIKPEAPREDASPEELNRYYASLRHYLNLVTRQ

SEQ ID NO: 556 - protein, 8 aa, Artificial Sequence
  peptide YY precursor 2
RYGKRDGP

SEQ ID NO: 557 - protein, 27 aa, Artificial Sequence
  peptide YY precursor 3
DTLLSKTFFPDGEDRPVRSRSEGPDLW

SEQ ID NO: 558 - protein, 34 aa, Artificial Sequence
  PYY Active form 1
IKPEAPREDASPEELNRYYASLRHYLNLVTRQRY

SEQ ID NO: 559 - protein, 34 aa, homo sapiens
IKPEAPGEDASPEELNRYYASLRHYLNLVTRQRY

SEQ ID NO: 560 - protein, 36 aa, homo sapiens
YPIKPEAPREDASPEELNRYYASLRHYLNLVTRQRY

SEQ ID NO: 561 - protein, 36 aa, homo sapiens
YPIKPEAPGEDASPEELNRYYASLRHYLNLVTRQRY

SEQ ID NO: 562 - protein, 52 aa, homo sapiens
YRQSMNNFQGLRSFGCRFGTCTVQKLAHQIYQFTDKDKDNVAPRSKISPQGY

SEQ ID NO: 563 - protein, 20 aa, Sus scrofa
ARLDVAAEFRKKWNKWALSR

SEQ ID NO: 564 - protein, 48 aa, Artificial Sequence
  PrePro-Adrenomedullin
ELRMSSSYPTGLADVKAGPAQTLIRPQDMKGASRSPEDSSPDAARIRV

SEQ ID NO: 565 - protein, 6 aa, Artificial Sequence
  Ghrelin analog sequences
  MISC_FEATURE (2)..(2): Xaa = D - Tryptophan
  MISC_FEATURE (4)..(4): Xaa = D - Tryptophan
AXFXLL

SEQ ID NO: 566 - protein, 5 aa, Artificial Sequence
  Ghrelin analog sequences
  MISC_FEATURE (1)..(1): Xaa = D - Tryptophan
  MISC_FEATURE (3)..(3): Xaa = D - Tryptophan
XFXLL

SEQ ID NO: 567 - protein, 28 aa, Artificial Sequence
  Ghrelin analog sequences
GSSFLSPEHQRVQQRKESKKPPAKLQPR

SEQ ID NO: 568 - protein, 25 aa, homo sapiens
FLSPEHQRVQQRKESKKPPAKLQPR

SEQ ID NO: 569 - protein, 23 aa, Artificial Sequence
  human Obestatin analog sequences
  MOD_RES (23)..(23): AMIDATION
FNAPFDVGIKLSGVQYQQHSQAL

SEQ ID NO: 570 - protein, 34 aa, homo sapiens
SVSEIQLMHNLGKHLNSMERVEWLRKKLQDVHNF

SEQ ID NO: 571 - protein, 35 aa, homo sapiens
SVSEIQLMHNLGKHLNSMERVEWLRKKLQDVHNFK

SEQ ID NO: 572 - protein, 5 aa, Artificial Sequence
  Parathyroid Hormone fragment
TRSAW

SEQ ID NO: 573 - protein, 39 aa, Artificial Sequence
  TIP 39  Tuberoinfundibular Neuropeptide
SLALADDAAFRERARLLAALERRHWLNSYMHKLLVLDAP

SEQ ID NO: 574 - protein, 40 aa, Artificial Sequence
  Hypercalcemia Malignancy Factor (1 - 40)
AVSEHQLLHDKGKSIQDLRRRFFLHHLIAEIHTAEIRATS

SEQ ID NO: 575 - protein, 6 aa, Artificial Sequence
  Acetalin 1  Opioid Receptor Antagonist 1
  MOD_RES (1)..(1): ACETYLATION
  MOD_RES (6)..(6): AMIDATION
RFMWMR

SEQ ID NO: 576 - protein, 6 aa, Artificial Sequence
  Acetalin 2  Opioid Receptor Antagonist 2
  MOD_RES (1)..(1): ACETYLATION
  MOD_RES (6)..(6): AMIDATION
RFMWMK

SEQ ID NO: 577 - protein, 6 aa, Artificial Sequence
  Acetalin 3  Opioid Receptor Antagonist 3
  MOD_RES (1)..(1): ACETYLATION
  MOD_RES (6)..(6): AMIDATION
RFMWMT

SEQ ID NO: 578 - protein, 17 aa, Artificial Sequence
  {Glu10} - ACTH (1 - 17)
SYSMEHFRWEKPVGKKR

SEQ ID NO: 579 - protein, 24 aa, Artificial Sequence
  {Phe2  Nle4} - ACTH (1 - 24)
  MISC_FEATURE (4)..(4): Xaa = Noraleucine
SFSXEHFRWGKPVGKKRRPVKVYP

SEQ ID NO: 580 - protein, 10 aa, Artificial Sequence
  ACTH (1 - 10)
SYSMEHFRWG

SEQ ID NO: 581 - protein, 13 aa, Artificial Sequence
  ACTH (1 - 13)
SYSMEHFRWGKPV

SEQ ID NO: 582 - protein, 24 aa, Artificial Sequence
  ACTH (1 - 24)
SYSMEHFRWGKPVGKKRRPVKVYP

SEQ ID NO: 583 - protein, 39 aa, Artificial Sequence
  ACTH (1 - 39)
SYSMEHFRWGKPVGKKRRPVKVYPNGAEDESAEAFPLEF

SEQ ID NO: 584 - protein, 22 aa, Artificial Sequence
  ACTH (18 - 39)
RPVKVYPNGAEDESAEAFPLEF

SEQ ID NO: 585 - protein, 18 aa, Artificial Sequence
  ACTH (22 - 39)
VYPNGAEDESAEAFPLEF

SEQ ID NO: 586 - protein, 32 aa, Artificial Sequence
  ACTH (7 - 38)
FRWGKPVGKKRRPVKVYPNGAEDESAEAFPLE

SEQ ID NO: 587 - protein, 40 aa, Artificial Sequence
  Sauvagine
  MISC_FEATURE (1)..(1): Xaa = Pyroglutamic acid
  MOD_RES (40)..(40): AMIDATION
XGPPISIDLSLELLRKMIEIEKQEKEKQQAANNRLLLDTI

SEQ ID NO: 588 - protein, 27 aa, Artificial Sequence
  AGRP (25 - 51)
LAPMEGIRRPDQALLPELPGLGLRAPL

SEQ ID NO: 589 - protein, 29 aa, Artificial Sequence
  AGRP (54 - 82)
TTAEQAEEDLLQEAQALAEVLDLQDREPR

SEQ ID NO: 590 - protein, 46 aa, Artificial Sequence
  AGRP (87 - 132)
  MOD_RES (1)..(1): ACETYLATION
CVRLHESCLGQQVPCCDPCATCYCRFFNAFCYCRKLGTAMNPCSRT

SEQ ID NO: 591 - protein, 50 aa, Artificial Sequence
  AGRP fragment (83 - 132)
  MOD_RES (50)..(50): AMIDATION
SSRRCVRLHESCLGQQVPCCDPCATCYCRFFNAFCYCRKLGTAMNPCSRT

SEQ ID NO: 592 - protein, 13 aa, Artificial Sequence
  Allatostatin I
APSGAQRLYGFGL

SEQ ID NO: 593 - protein, 13 aa, Artificial Sequence
  Allatostatin I  Dip - AST7
  MOD_RES (13)..(13): AMIDATION
APSGAQRLYGFGL

SEQ ID NO: 594 - protein, 10 aa, Artificial Sequence
  Allatostatin II
  MOD_RES (10)..(10): AMIDATION
GDGRLYAFGL

SEQ ID NO: 595 - protein, 9 aa, Artificial Sequence
  Allatostatin III
  MOD_RES (9)..(9): AMIDATION
GGSLYSFGL

SEQ ID NO: 596 - protein, 8 aa, Artificial Sequence
  Allatostatin IV
  MOD_RES (8)..(8): AMIDATION
DRLYSFGL

SEQ ID NO: 597 - protein, 11 aa, Artificial Sequence
  Allatostatin VI
  MOD_RES (11)..(11): AMIDATION
YPQEHRFSFGL

SEQ ID NO: 598 - protein, 9 aa, Artificial Sequence
  Allatostatin VII
  MOD_RES (9)..(9): AMIDATION
DGRMYSFGL

SEQ ID NO: 599 - protein, 13 aa, Artificial Sequence
  Allatotropin  Mas - AT
  MOD_RES (13)..(13): AMIDATION
GFKNVEMMTARGF

SEQ ID NO: 600 - protein, 27 aa, Artificial Sequence
  {Ala16 17 20} - beta - Amyloid (1 - 28)
DAEFRHDSGYEVHHQAAVFAAEDVGSN

SEQ ID NO: 601 - protein, 9 aa, Artificial Sequence
  {Gln22} - beta - Amyloid (15 - 23)
QKLVFFAQD

SEQ ID NO: 602 - protein, 6 aa, Artificial Sequence
  {NMeG24  NMeI26} Human Islet Amyloid Polypeptide (IAPP) (22 - 27)
  MISC_FEATURE (3)..(3): Xaa = N-methyl Glycine
  MISC_FEATURE (5)..(5): Xaa = N-methyl Isoleucine
NFXAXL

SEQ ID NO: 603 - protein, 13 aa, Artificial Sequence
  Amylin (1 - 13)
  DISULFID (2)..(7): Disulfide Bond
KCNTATCATQRLA

SEQ ID NO: 604 - protein, 37 aa, homo sapiens [sequence omitted]

SEQ ID NO: 605 - protein, 10 aa, Artificial Sequence
  Amylin (20 - 29)
SNNFGAILSS

SEQ ID NO: 606 - protein, 30 aa, Artificial Sequence
  Amylin (8 - 37)
  MOD_RES (30)..(30): AMIDATION
ATQRLANFLVHSSNNFGAILSSTNVGSNTY

SEQ ID NO: 607 - protein, 13 aa, Artificial Sequence
  Beta - Amyloid (12 - 24)
VHHQKLVFFAEDV

SEQ ID NO: 608 - protein, 11 aa, Artificial Sequence
  Beta - Amyloid (13 - 23)
HHQKLVFFAED

SEQ ID NO: 609 - protein, 23 aa, Artificial Sequence
  Beta - Amyloid (7 - 29)
DSGYEVHHQKLVFFAEDVGSNKG

SEQ ID NO: 610 - protein, 9 aa, Artificial Sequence
  Angiotensin
RVYIHPFHL

SEQ ID NO: 611 - protein, 8 aa, Artificial Sequence
  {Sar1  Ala8} - Angiotensin II
  MISC_FEATURE (1)..(1): Xaa = N-methyl Glycine
XRVYIHPA

SEQ ID NO: 612 - protein, 8 aa, Artificial Sequence
  {Sar1  Val5  Ala8} - Angiotensin II  Saralasin
  MISC_FEATURE (1)..(1): Xaa = N-methyl Glycine
XRVYVHPA

SEQ ID NO: 613 - protein, 7 aa, Artificial Sequence
  Angiotensin I Converting Enzyme 2  ACE - 2/Caspase - 1 Substrate
YVADAPK

SEQ ID NO: 614 - protein, 10 aa, Equus caballus
DRVYIHPFHL

SEQ ID NO: 615 - protein, 8 aa, Artificial Sequence
  Angiotensin II Antipeptide
EGVYVHPV

SEQ ID NO: 616 - protein, 6 aa, Artificial Sequence
  Angiotensin I/II (3 - 8)
VYIHPF

SEQ ID NO: 617 - protein, 5 aa, Artificial Sequence
  Angiotensin I/II (4 - 8)
YIHPF

SEQ ID NO: 618 - protein, 4 aa, Artificial Sequence
  Angiotensin I/II (5 - 8)
IHPF

SEQ ID NO: 619 - protein, 8 aa, Artificial Sequence
  Angiotensin II Substrate
  MISC_FEATURE (4)..(4): Xaa = Phosphorolyated Tyrosine
DRVXIHPF

SEQ ID NO: 620 - protein, 8 aa, Artificial Sequence
  Angiotensin II b
DRVYIHPF

SEQ ID NO: 621 - protein, 7 aa, Artificial Sequence
  Angiotensin III
RVYIHPF

SEQ ID NO: 622 - protein, 10 aa, Artificial Sequence
  Prorenin Peptide (33 - 42)
RIFLKRMPSI

SEQ ID NO: 623 - protein, 14 aa, homo sapiens
DRVYIHPFHLVIHN

SEQ ID NO: 624 - protein, 9 aa, Artificial Sequence
  Renin Inhibitor III
  MISC_FEATURE (6)..(6): Xaa = Statine
  MOD_RES (9)..(9): AMIDATION
RRPFHXIHK

SEQ ID NO: 625 - protein, 11 aa, Artificial Sequence
  Annexin 1 (ANXA - 1  Ac 2 - 12)
  MOD_RES (1)..(1): ACETYLATION
AMVSEFLKQAW

SEQ ID NO: 626 - protein, 9 aa, Artificial Sequence
  Anti - Inflammatory Peptide 1
MQMKKVLDS

SEQ ID NO: 627 - protein, 9 aa, Artificial Sequence
  Anti - Inflammatory Peptide 2
HDMNKVLDL

SEQ ID NO: 628 - protein, 9 aa, Artificial Sequence
  Anti - Inflammatory Peptide 3
MQMNKVLDS

SEQ ID NO: 629 - protein, 12 aa, Artificial Sequence
  Interleukin - 6 Receptor Peptide
TSLPVQDSSSVP

SEQ ID NO: 630 - protein, 13 aa, Artificial Sequence
  {Ala13} - Apelin - 13
QRPRLSHKGPMPA

SEQ ID NO: 631 - protein, 17 aa, Artificial Sequence
  {Phe17} - Apelin 17
KFRRQRPRLSHKGPMPF

SEQ ID NO: 632 - protein, 13 aa, Artificial Sequence
  {Pyr1} - Apelin - 13
  MISC_FEATURE (1)..(1): Xaa = Pyroglutamic acid
XRPRLSHKGPMPF

SEQ ID NO: 633 - protein, 12 aa, Artificial Sequence
  Apelin 12
RPRLSHKGPMPF

SEQ ID NO: 634 - protein, 13 aa, Artificial Sequence
  Apelin - 15 (63 - 75)
RRQRPRLSHKGPM

SEQ ID NO: 635 - protein, 16 aa, Artificial Sequence
  Apelin - 16
FRRQRPRLSHKGPMPF

SEQ ID NO: 636 - protein, 36 aa, Artificial Sequence
  Apelin - 36
LVQPRGSRNGPGPWQGGRRKFRRQRPRLSHKGPMPF

SEQ ID NO: 637 - protein, 19 aa, Artificial Sequence
  Bak BH3  Bcl2 (72 - 87)
KGGGQVGRQLAIIGDDINR

SEQ ID NO: 638 - protein, 39 aa, Artificial Sequence
  PR39  Anti - Apoptotic Factor
RRRPRPPYLPRPRPPPFFPPRLPPRIPPGFPPRFPPRFP

SEQ ID NO: 639 - protein, 14 aa, Artificial Sequence
  Proapoptotic Peptide  (klaklak)2
  MISC_FEATURE (1)..(1): Xaa = D - Lysine
  MISC_FEATURE (2)..(2): Xaa = D - Leucine
  MISC_FEATURE (3)..(3): Xaa = D - Alanine
  MISC_FEATURE (4)..(4): Xaa = D - Lysine
  MISC_FEATURE (5)..(5): Xaa = D - Leucine
  MISC_FEATURE (6)..(6): Xaa = D - Alanine
  MISC_FEATURE (7)..(7): Xaa = D - Lysine
  MISC_FEATURE (8)..(8): Xaa = D - Lysine
  MISC_FEATURE (9)..(9): Xaa = D - Leucine
  MISC_FEATURE (10)..(10): Xaa = D - Alanine
  MISC_FEATURE (11)..(11): Xaa = D - Lysine
  MISC_FEATURE (12)..(12): Xaa = D - Leucine
  MISC_FEATURE (13)..(13): Xaa = D - Alanine
  MOD_RES (14)..(14): AMIDATION
  MISC_FEATURE (14)..(14): Xaa = D - Lysine
XXXXXXXXXXXXXX

SEQ ID NO: 640 - protein, 25 aa, Artificial Sequence
  PUMA BH3
EEQWAREIGAQLRRMADDLNAQYER

SEQ ID NO: 641 - protein, 24 aa, Artificial Sequence
  RGD - targeted Proapoptotic Peptide
  MOD_RES (1)..(1): ACETYLATION
  DISULFID (1)..(4): Disulfide Bond
  DISULFID (2)..(3): Disulfide Bond
  MISC_FEATURE (11)..(11): Xaa = D - Lysine
  MISC_FEATURE (12)..(12): Xaa = D - Leucine
  MISC_FEATURE (13)..(13): Xaa = D - Alanine
  MISC_FEATURE (14)..(14): Xaa = D - Lysine
  MISC_FEATURE (15)..(15): Xaa = D - Leucine
  MISC_FEATURE (16)..(16): Xaa = D - Alanine
  MISC_FEATURE (17)..(17): Xaa = D - Lysine
  MISC_FEATURE (18)..(18): Xaa = D - Lysine
  MISC_FEATURE (19)..(19): Xaa = D - Leucine
  MISC_FEATURE (20)..(20): Xaa = D - Alanine
  MISC_FEATURE (21)..(21): Xaa = D - Lysine
  MISC_FEATURE (22)..(22): Xaa = D - Leucine
  MISC_FEATURE (23)..(23): Xaa = D - Alanine
  MOD_RES (24)..(24): AMIDATION
  MISC_FEATURE (24)..(24): Xaa = D - Lysine
DCRGDCFCGGXXXXXXXXXXXXXX

SEQ ID NO: 642 - protein, 26 aa, Artificial Sequence
  26Rfa  Hypothalamic Peptide
  MOD_RES (26)..(26): AMIDATION
TSGPLGNLAEELNGYSRKKGGFSFRF

SEQ ID NO: 643 - protein, 7 aa, Artificial Sequence
  Catch - Relaxing Peptide (CARP)
  MOD_RES (7)..(7): AMIDATION
AMPMLRL

SEQ ID NO: 644 - protein, 18 aa, Artificial Sequence
  Neuropeptide AF (hNPAF)
  MOD_RES (18)..(18): AMIDATION
AGEGLNSQFWSLAAPQRF

SEQ ID NO: 645 - protein, 37 aa, Artificial Sequence
  NPSF (1 - 37)  Neuropeptide SF (1 - 37)
  MOD_RES (37)..(37): AMIDATION
SLNFEELKDWGPKNVIKMSTPAVNKMPHSFANLPLRF

SEQ ID NO: 646 - protein, 10 aa, Artificial Sequence
  LOCUST (AKH-I)
  MISC_FEATURE (1)..(1): Xaa = Phosphorolyated Glu
XLNFTPNWGT

SEQ ID NO: 647 - protein, 10 aa, Artificial Sequence
  CARAUSIUS (HTF-II)
  MISC_FEATURE (1)..(1): Xaa = Phosphorolyated Glu
XLTFTPNWGT

SEQ ID NO: 648 - protein, 9 aa, Artificial Sequence
  SYNTHETIC
LTFTPNWGT

SEQ ID NO: 649 - protein, 9 aa, Artificial Sequence
  SYNTHETIC
  MISC_FEATURE (1)..(1): Xaa = Phosphorolyated Glu
XLTFTPNWG

SEQ ID NO: 650 - protein, 8 aa, Artificial Sequence
  CRUSTACEAN (RPCH)
  MISC_FEATURE (1)..(1): Xaa = Phosphorolyated Glu
XLNFSPGW

SEQ ID NO: 651 - protein, 8 aa, Artificial Sequence
  LOCUSTA (AKH-II)
  MISC_FEATURE (1)..(1): Xaa = Phosphorolyated Glu
XLNFSAGW

SEQ ID NO: 652 - protein, 8 aa, Artificial Sequence
  SCHISTOCERCA
  MISC_FEATURE (1)..(1): Xaa = Phosphorolyated Glu
XLNFSTGW

SEQ ID NO: 653 - protein, 8 aa, Artificial Sequence
  PERIPLANETA M-I
  MISC_FEATURE (1)..(1): Xaa = Phosphorolyated Glu
XVNFSPNW

SEQ ID NO: 654 - protein, 8 aa, Artificial Sequence
  PERIPLANETA M-II
  MISC_FEATURE (1)..(1): Xaa = Phosphorolyated Glu
XLTFTPNW

SEQ ID NO: 655 - protein, 9 aa, Artificial Sequence
  NEUPHOETA / BLABERUS HTH
  MISC_FEATURE (1)..(1): Xaa = Phosphorolyated Glu
XVNFSPGWT

SEQ ID NO: 656 - protein, 10 aa, Artificial Sequence
  ROMALEA-I
  MISC_FEATURE (1)..(1): Xaa = Phosphorolyated Glu
XVNFTPNWGT

SEQ ID NO: 657 - protein, 8 aa, Artificial Sequence
  ROMALEA-II/Gryllus
  MISC_FEATURE (1)..(1): Xaa = Phosphorolyated Glu
XVNFSAGW

SEQ ID NO: 658 - protein, 1242 aa, homo sapiens
MASPPESDGFSDVRKVGYLRKPKSMHKRFFVLRAASEAGGPARLEYYENEKKWRHKSSAPKRSIPLESCFNINKRADSKNKHLVALYTRDEHFAIAADSEAEQDSWYQALLQLHNRAKGHHDGAAALGAGGGGGSCSGSSGLGEAGEDLSYGDVPPGPAFKEVWQVILKPKGLGQTKNLIGIYRLCLTSKTISFVKLNSEAAAVVLQLMNIRRCGHSENFFFIEVGRSAVTGPGEFWMQVDDSVVAQNMHETILEAMRAMSDEFRPRSKSQSSSNCSNPISVPLRRHHLNNPPPSQVGLTRRSRTESITATSPASMVGGKPGSFRVRASSDGEGTMSRPASVDGSPVSPSTNRTHAHRHRGSARLHPPLNHSRSIPMPASRCSPSATSPVSLSSSSTSGHGSTSDCLFPRRSSASVSGSPSDGGFISSDEYGSSPCDFRSSFRSVTPDSLGHTPPARGEEELSNYICMGGKGPSTLTAPNGHYILSRGGNGHRCTPGTGLGTSPALAGDEAASAADLDNRFRKRTHSAGTSPTITHQKTPSQSSVASIEEYTEMMPAYPPGGGSGGRLPGHRHSAFVPTRSYPEEGLEMHPLERRGGHHRPDSSTLHTDDGYMPMSPGVAPVPSGRKGSGDYMPMSPKSVSAPQQIINPIRRHPQRVDPNGYMMMSPSGGCSPDIGGGPSSSSSSSNAVPSGTSYGKLWTNGVGGHHSHVLPHPKPPVESSGGKLLPCTGDYMNMSPVGDSNTSSPSDCYYGPEDPQHKPVLSYYSLPRSFKHTQRPGEPEEGARHQHLRLSTSSGRLLYAATADDSSSSTSSDSLGGGYCGARLEPSLPHPHHQVLQPHLPRKVDTAAQTNSRLARPTRLSLGDPKASTLPRAREQQQQQQPLLHPPEPKSPGEYVNIEFGSDQSGYLSGPVAFHSSPSVRCPSQLQPAPREEETGTEEYMKMDLGPGRRAAWQESTGVEMGRLGPAPPGAASICRPTRAVPSSRGDYMTMQMSCPRQSYVDTSPAAPVSYADMRTGIAAEEVSLPRATMAAASSSSAASASPTGPQGAAELAAHSSLLGGPQGPGGMSAFTRVNLSPNRNQSAKVIRADPQGCRRRHSSETFSSTPSATRVGNTVPFGAGAAVGGGGGSSSSSEDVKRHSSASFENVWLRPGELGGAPKEPAKLCGAAGGLENGLNYIDLDLVKDFKQCPQECTPEPQPPPPPPPHQPLGSGESSSTRRSSEDLSAYASISFQKQPEDRQ

SEQ ID NO: 659 - protein, 110 aa, homo sapiens
MALWMRLLPLLALLALWGPDPAAAFVNQHLCGSHLVEALYLVCGERGFFYTPKTRREAEDLQVGQVELGGGPGAGSLQPLALEGSLQKRGIVEQCCTSICSLYQLENYCN

SEQ ID NO: 660 - protein, 21 aa, Artificial Sequence
  ACTIVE (human) INSULIN fragment chain A
GIVEQCCTSICSLYQLENYCN

SEQ ID NO: 661 - protein, 30 aa, Artificial Sequence
  ACTIVE (human) INSULIN fragment Chain B
  DISULFID (6)..(11): Disulfide Bond
  DISULFID (7)..(7): Disulfide Bond
  DISULFID (19)..(20): Disulfide Bond
FVNQHLCGSHLVEALYLVCGERGFFYTPKT

SEQ ID NO: 662 - protein, 21 aa, Artificial Sequence
  Insulin Glargine Chain A
GIVEQCCTSICSLYQLENYCG

SEQ ID NO: 663 - protein, 21 aa, Artificial Sequence
  Insulin Glargine Chain A
  MOD_RES (1)..(1): ACETYLATION
GIVEQCCTSICSLYQLENYCG

SEQ ID NO: 664 - protein, 21 aa, Artificial Sequence
  Insulin Glargine Chain A
  MOD_RES (21)..(21): AMIDATION
GIVEQCCTSICSLYQLENYCG

SEQ ID NO: 665 - protein, 21 aa, Artificial Sequence
  Insulin Glargine Chain A
  MOD_RES (1)..(1): ACETYLATION
  MOD_RES (21)..(21): AMIDATION
GIVEQCCTSICSLYQLENYCG

SEQ ID NO: 666 - protein, 32 aa, Artificial Sequence
  Insulin Glargine Chain B
FVNQHLCGSHLVEALYLVCGERGFFYTPKTRR

SEQ ID NO: 667 - protein, 32 aa, Artificial Sequence; identical to SEQ ID NO: 666
  Insulin Glargine Chain B
  MOD_RES (1)..(1): ACETYLATION

SEQ ID NO: 668 - protein, 32 aa, Artificial Sequence; identical to SEQ ID NO: 666
  Insulin Glargine Chain B
  MOD_RES (32)..(32): AMIDATION

SEQ ID NO: 669 - protein, 32 aa, Artificial Sequence; identical to SEQ ID NO: 666
  Insulin Glargine Chain B
  MOD_RES (1)..(1): ACETYLATION
  MOD_RES (32)..(32): AMIDATION

SEQ ID NO: 670 - protein, 21 aa, Artificial Sequence
  Insulin Lispro Chain A
  MOD_RES (1)..(1): ACETYLATION
GIVEQCCTSICSLYQLENYCN

SEQ ID NO: 671 - protein, 21 aa, Artificial Sequence
  Insulin Lispro Chain A
  MOD_RES (21)..(21): AMIDATION
GIVEQCCTSICSLYQLENYCN

SEQ ID NO: 672 - protein, 21 aa, Artificial Sequence
  Insulin Lispro Chain A
  MOD_RES (1)..(1): ACETYLATION
  MOD_RES (21)..(21): AMIDATION
GIVEQCCTSICSLYQLENYCN

SEQ ID NO: 673 - protein, 30 aa, Artificial Sequence
  Insulin Lispro Chain B
FVNQHLCGSHLVEALYLVCGERGFFYTKPT

SEQ ID NO: 674 - protein, 30 aa, Artificial Sequence; identical to SEQ ID NO: 673
  Insulin Lispro Chain B
  MOD_RES (1)..(1): ACETYLATION

SEQ ID NO: 675 - protein, 30 aa, Artificial Sequence; identical to SEQ ID NO: 673
  Insulin Lispro Chain B
  MOD_RES (30)..(30): AMIDATION

SEQ ID NO: 676 - protein, 30 aa, Artificial Sequence; identical to SEQ ID NO: 673
  Insulin Lispro Chain B
  MOD_RES (1)..(1): ACETYLATION
  MOD_RES (30)..(30): AMIDATION

SEQ ID NO: 677 - protein, 30 aa, Artificial Sequence
  Insulin Aspart Chain B
FVNQHLCGSHLVEALYLVCGERGFFYTDKT

SEQ ID NO: 678 - protein, 30 aa, Artificial Sequence; identical to SEQ ID NO: 677
  Insulin Aspart Chain B
  MOD_RES (1)..(1): ACETYLATION

SEQ ID NO: 679 - protein, 30 aa, Artificial Sequence; identical to SEQ ID NO: 677
  Insulin Aspart Chain B
  MOD_RES (30)..(30): AMIDATION

SEQ ID NO: 680 - protein, 30 aa, Artificial Sequence; identical to SEQ ID NO: 677
  Insulin Aspart Chain B
  MOD_RES (1)..(1): ACETYLATION
  MOD_RES (30)..(30): AMIDATION

SEQ ID NO: 681 - protein, 37 aa, Artificial Sequence
  Oxm
HSQGTFTSDYSKYLDSRRAQDFVQWLMNTKRNRNNIA

SEQ ID NO: 682 - protein, 37 aa, Artificial Sequence
  DHis1-Oxm
  MISC_FEATURE (1)..(1): Xaa = D - Histadine
XSQGTFTSDYSKYLDSRRAQDFVQWLMNTKRNRNNIA

SEQ ID NO: 683 - protein, 37 aa, Artificial Sequence
  Ala2-Oxm
HAQGTFTSDYSKYLDSRRAQDFVQWLMNTKRNRNNIA

SEQ ID NO: 684 - protein, 37 aa, Artificial Sequence
  DHis1-Ala2-Oxm
  MISC_FEATURE (1)..(1): Xaa = D - Histadine
XAQGTFTSDYSKYLDSRRAQDFVQWLMNTKRNRNNIA

SEQ ID NO: 685 - protein, 37 aa, Artificial Sequence
  Oxm(ex15-18)
HSQGTFTSDYSKYLEEEAAQDFVQWLMNTKRNRNNIA

SEQ ID NO: 686 - protein, 37 aa, Artificial Sequence
  Oxm(ex15-21)
HSQGTFTSDYSKYLEEEAVRLFVQWLMNTKRNRNNIA

SEQ ID NO: 687 - protein, 37 aa, Artificial Sequence
  Oxm(ex15-23)
HSQGTFTSDYSKYLEEEAVRLFIQWLMNTKRNRNNIA

SEQ ID NO: 688 - protein, 37 aa, Artificial Sequence
  Oxm(ex15-24)
HSQGTFTSDYSKYLEEEAVRLFIEWLMNTKRNRNNIA

SEQ ID NO: 689 - protein, 37 aa, Artificial Sequence
  Oxm(ex27-33)
HSQGTFTSDYSKYLDSRRAQDFVQWLKNGGPSSNNIA

SEQ ID NO: 690 - protein, 37 aa, Artificial Sequence
  Oxm(ex29-33)
HSQGTFTSDYSKYLDSRRAQDFVQWLMNGGPSSNNIA

SEQ ID NO: 691 - protein, 37 aa, Artificial Sequence
  Oxm(ex30-33)
HSQGTFTSDYSKYLDSRRAQDFVQWLMNTGPSSNNIA

SEQ ID NO: 692 - protein, 19 aa, Artificial Sequence
  Oxm(ex27-30)
HSQGTFTSDYSKYLDSRRA

SEQ ID NO: 693 - protein, 18 aa, Artificial Sequence
  Oxm(ex27-30)
QDFVQWLKNGGRNRNNIA

SEQ ID NO: 694 - protein, 19 aa, Artificial Sequence
  Oxm19-37
AQDFVQWLMNTKRNRNNIA

SEQ ID NO: 695 - protein, 8 aa, Artificial Sequence
  Oxm30-37
KRNRNNIA

SEQ ID NO: 696 - protein, 27 aa, Artificial Sequence
  Oxm-Ala38
HSQGTFTSDYSKYLDSRRAQDFVQWLM

SEQ ID NO: 697 - protein, 11 aa, Artificial Sequence
  Oxm-Ala38
NTKRNRNNIAA

SEQ ID NO: 698 - protein, 25 aa, Artificial Sequence
  Oxm-Ala38 39
HSQGTFTSDYSKYLDSRRAQDFVQW

SEQ ID NO: 699 - protein, 14 aa, Artificial Sequence
  Oxm-Ala38 39
LMNTKRNRNNIAAA

SEQ ID NO: 700 - protein, 17 aa, Artificial Sequence
  Oxm-Ala38-42
LMNTKRNRNNIAAAAAA

SEQ ID NO: 701 - protein, 13 aa, Artificial Sequence
  Oxm-Lys38-Laur
  MISC_FEATURE (13)..(13): Xaa = LAUROYL - Lysine
LMNTKRNRNNIAX

SEQ ID NO: 702 - protein, 13 aa, Artificial Sequence
  Oxm-Lys38-Palm
  MISC_FEATURE (13)..(13): Xaa = PALMITOYL - Lysine
LMNTKRNRNNIAX

SEQ ID NO: 703 - protein, 13 aa, Artificial Sequence
  Oxm-Ala38 39-Lys40Laur
  MISC_FEATURE (13)..(13): Xaa = LAUROYL - Lysine
NTKRNRNNIAAAX

SEQ ID NO: 704 - protein, 40 aa, Artificial Sequence
  Oxm-Ala38 39-Lys40Palm
  MISC_FEATURE (1)..(1): Xaa = D - Histadine
  MISC_FEATURE (40)..(40): Xaa = PALMITOYL - Lysine
XSQGTFTSDYSKYLDSRRAQDFVQWLMNTKRNRNNIAAAX

SEQ ID NO: 705 - protein, 40 aa, Artificial Sequence
  Oxm(ex15-23)
  MISC_FEATURE (1)..(1): Xaa = D - Histadine
  MISC_FEATURE (40)..(40): Xaa = LAUROYL - Lysine
XAQGTFTSDYSKYLEEEAVRLFIQWKNGGPSSRNNIAAAX

SEQ ID NO: 706 - protein, 7 aa, Artificial Sequence
  MC-4R Agonist (Cyclo (-Ala-His-D-Phe-Arg-Trp-Glu)-NH2) 1
  MOD_RES (1)..(1): ACETYLATION
  MISC_FEATURE (1)..(1): Xaa = Noraleucine
  MISC_FEATURE (4)..(4): Xaa = d-Tyrosine
  MOD_RES (7)..(7): AMIDATION
XDHXRWK

SEQ ID NO: 707 - protein, 14 aa, Artificial Sequence
  MC-4R Agonist (Cyclo (-Ala-His-D-Phe-Arg-Trp-Glu)-NH2) 2
  MOD_RES (1)..(1): ACETYLATION
  MISC_FEATURE (1)..(1): Xaa = 2-aminocyclopentanecarboxylic Acid
  MISC_FEATURE (5)..(5): Xaa = Noraleucine
  MOD_RES (14)..(14): AMIDATION
XKYVXGHFRWDRFG

SEQ ID NO: 708 - protein, 13 aa, Artificial Sequence
  MC-4R Agonist (Cyclo (-Ala-His-D-Phe-Arg-Trp-Glu)-NH2) 3
  MOD_RES (1)..(1): ACETYLATION
  MISC_FEATURE (4)..(4): Xaa = Noraleucine
  MOD_RES (13)..(13): AMIDATION
KYVXGHFRWDRFG

SEQ ID NO: 709 - protein, 14 aa, Artificial Sequence
  MC-4R Agonist (Cyclo (-Ala-His-D-Phe-Arg-Trp-Glu)-NH2) 4
  MOD_RES (1)..(1): ACETYLATION
  MISC_FEATURE (1)..(1): Xaa = 2-aminocyclopentanecarboxylic Acid
  MOD_RES (14)..(14): AMIDATION
XSYSMEHFRWGKPV

SEQ ID NO: 710 - protein, 13 aa, Artificial Sequence
  MC-4R Agonist (Cyclo (-Ala-His-D-Phe-Arg-Trp-Glu)-NH2) 5
  MOD_RES (1)..(1): ACETYLATION
  MOD_RES (13)..(13): AMIDATION
SYSMEHFRWGKPV

SEQ ID NO: 711 - protein, 31 aa, homo sapiens
YGGFMTSEKSQTPLVTLFKNAIIKNAYKKGE

SEQ ID NO: 712 - protein, 21 aa, Artificial Sequence
  {Ala1 3 11 16} - Endothelin 1
ASASSLMDKEAVYFAHLDIIW

SEQ ID NO: 713 - protein, 21 aa, homo sapiens
  DISULFID (1)..(15): Disulfide Bond
  DISULFID (3)..(11): Disulfide Bond
CSCSSLMDKECVYFCHLDIIW

SEQ ID NO: 714 - protein, 21 aa, Artificial Sequence
  Endothelin 2
  DISULFID (1)..(15): Disulfide Bond
  DISULFID (3)..(11): Disulfide Bond
CSCSSWLDKECVYFCHLDIIW

SEQ ID NO: 715 - protein, 17 aa, Artificial Sequence
  Orphanin FQ2  (OFQ2  NOCII)
FSEFMRQYLVLSMQSSQ

SEQ ID NO: 716 - protein, 39 aa, Artificial Sequence
  {Des - His1  Glu8} - Exendin - 4
  MISC_FEATURE (1)..(1): Xaa = Des - Histadine
  MOD_RES (39)..(39): AMIDATION
XGEGTPTSELSKQMEEEAVRLPIEWLKNGGPSSGAPPPS

SEQ ID NO: 717 - protein, 39 aa, Heloderma suspectum
  MOD_RES (39)..(39): AMIDATION
HGEGTFTSDLSKQMEEEAVRLFIEWLKNGGPSSGAPPPS

SEQ ID NO: 718 - protein, 30 aa, Artificial Sequence
  Exendin (10 - 39)
  MOD_RES (30)..(30): AMIDATION
LSKQMEEEAVRLFIEWLKNGGPSSGAPPPS

SEQ ID NO: 719 - protein, 36 aa, Artificial Sequence
  Exendin (4 - 39)
  MOD_RES (36)..(36): AMIDATION
GTFTSDLSKQMEEEAVRLFIEWLKNGGPSSGAPPPS

SEQ ID NO: 720 - protein, 35 aa, Artificial Sequence
  Exendin (5 - 39)
  MOD_RES (35)..(35): AMIDATION
TFTSDLSKQMEEEAVRLFIEWLKNGGPSSGAPPPS

SEQ ID NO: 721 - protein, 33 aa, Artificial Sequence
  Exendin (7 - 39)
  MOD_RES (33)..(33): AMIDATION
TSDLSKQMEEEAVRLFIEWLKNGGPSSGAPPPS

SEQ ID NO: 722 - protein, 31 aa, Artificial Sequence
  Exendin (9 - 39)
  MOD_RES (31)..(31): AMIDATION
DLSKQMEEEAVRLFIEWLKNGGPSSGAPPPS

SEQ ID NO: 723 - protein, 31 aa, Artificial Sequence; identical to SEQ ID NO: 722
  Exendin (9 - 39)
  MOD_RES (31)..(31): AMIDATION

SEQ ID NO: 724 - protein, 39 aa, Artificial Sequence
  Exendin 3
  MOD_RES (39)..(39): AMIDATION
HSDGTFTSDLSKQMEEEAVRLFIEWLKNGGPSSGAPPPS

SEQ ID NO: 725 - protein, 30 aa, Artificial Sequence; identical to SEQ ID NO: 529
  Glicentin - Related Peptide (21 - 50)
  MOD_RES (30)..(30): AMIDATION

SEQ ID NO: 726 - protein, 26 aa, Artificial Sequence
  _1(I) Collagen (614 - 639)  Type I Collagen _1(I) C
SAGFDFSFLPQPPQEKAHDGGRYYRA

SEQ ID NO: 727 - protein, 56 aa, Artificial Sequence
  FDC - SP (30 - 85)
SISDSDELASGFFVFPYPYPFRPLPPIPFPRFPWFRRNFPIPIPESAPTTPLPSEK

SEQ ID NO: 728 - protein, 25 aa, Artificial Sequence
  FDC - SP (61 - 85)
FPWFRRNFPIPIPESAPTTPLPSEK

SEQ ID NO: 729 - protein, 16 aa, homo sapiens
ADSGEGDFLAEGGGVR

SEQ ID NO: 730 - protein, 14 aa, Artificial Sequence
  Fibrinopeptide B
  MISC_FEATURE (1)..(1): Xaa = Pyroglutamic acid
XGVNDNEEGFFSAR

SEQ ID NO: 731 - protein, 19 aa, Artificial Sequence
  Gamma - Fibrinogen (377 - 395)
YSMKETTMKIIPFNRLSIG

SEQ ID NO: 732 - protein, 14 aa, Artificial Sequence [sequence omitted]

SEQ ID NO: 733 - protein, 16 aa, Artificial Sequence
  EAK16 - II
  MOD_RES (16)..(16): AMIDATION
AEAEAKAKAEAEAKAK

SEQ ID NO: 734 - protein, 18 aa, Artificial Sequence
  Elastin - Like Octapeptide
GVGVPGVGVPGVGVPGVG

SEQ ID NO: 735 - protein, 19 aa, Artificial Sequence
  Fibrinogen _ - Chain (24 - 42)
EEAPSLRPAPPPISGGGYR

SEQ ID NO: 736 - protein, 17 aa, Artificial Sequence
  Fibrinogen _ - Chain (117 - 133)
NNQKIVNLKEKVAQLEA

SEQ ID NO: 737 - protein, 15 aa, Artificial Sequence
  Fibrinogen _ - Chain (397 - 411)
GQQHHLGGAKQAGDV

SEQ ID NO: 738 - protein, 12 aa, Artificial Sequence
  Fibrinogen Binding Inhibitor Peptide
HHLGGAKQAGDV

SEQ ID NO: 739 - protein, 5 aa, Artificial Sequence
  Fibrinogen - Binding Peptide
EHIPA

SEQ ID NO: 740 - protein, 15 aa, Artificial Sequence
  {Ala6 D - Trp8} - Galanin (1 - 15) - ol
  MISC_FEATURE (8)..(8): Xaa = D - Tryptophan
GWTLNAAXYLLGPHA

SEQ ID NO: 741 - protein, 15 aa, Artificial Sequence
  {D - Trp6 8 9} - Galanin (1 - 15) - ol
  MISC_FEATURE (6)..(6): Xaa = D - Tryptophan
  MISC_FEATURE (8)..(8): Xaa = D - Tryptophan
  MISC_FEATURE (9)..(9): Xaa = D - Tryptophan
GWTLNXAXXLLGPHA

SEQ ID NO: 742 - protein, 30 aa, homo sapiens
GWTLNSAGYLLGPHAVGNHRSFSDKNGLTS

SEQ ID NO: 743 - protein, 21 aa, Artificial Sequence
  Galanin (1 - 13) - Bradykinin (2 - 9)  amide  M35
  MOD_RES (21)..(21): AMIDATION
GWTLNSAGYLLGPPPGFSPFR

SEQ ID NO: 744 - protein, 25 aa, Artificial Sequence
  Galanin (1 - 13) - Neuropeptide Y (25 - 36)  amide  M32
  MOD_RES (25)..(25): AMIDATION
GWTLNSAGYLLGPRHYINLITRQRY

SEQ ID NO: 745 - protein, 20 aa, Artificial Sequence
  Galanin (1 - 13) - Pro - Pro - (Ala - Leu)2 - Ala  amide
  MOD_RES (20)..(20): AMIDATION
GWTLNSAGYLLGPPPALALA

SEQ ID NO: 746 - protein, 24 aa, Artificial Sequence
  Galanin (1 - 13) - Spantide I  C7
  MISC_FEATURE (14)..(14): Xaa = Beta-3 homo- Arginine
  MISC_FEATURE (20)..(20): Xaa = Beta-3 homo- Tryptophan
  MISC_FEATURE (22)..(22): Xaa = Beta-3 homo- Tryptophan
  MOD_RES (24)..(24): AMIDATION
GWTLNSAGYLLGPXPKPQQXFXLL

SEQ ID NO: 747 - protein, 24 aa, Artificial Sequence
  Galanin (1 - 13) - Spantide I  C8, synthesized
  MISC_FEATURE (14)..(14): Xaa = Beta-3 homo- Arginine
  MISC_FEATURE (20)..(20): Xaa = Beta-3 homo- Tryptophan
  MISC_FEATURE (22)..(22): Xaa = Beta-3 homo- Tryptophan
  MOD_RES (24)..(24): AMIDATION
GWTLNSAGYLLGPXPKPQQXFXLL

SEQ ID NO: 748 - protein, 20 aa, Artificial Sequence
  Galanin (1 - 13) - Substance P (5 - 11), Galantide, synthesized
  MOD_RES (20)..(20): AMIDATION
GWTLNSAGYLLGPQQFFGLM

SEQ ID NO: 749 - protein, 13 aa, Artificial Sequence
  Galanin (1 - 13)/ Galanin Like Peptide (GALP) (9 - 21), synthesized
GWTLNSAGYLLGP

SEQ ID NO: 750 - protein, 41 aa, Artificial Sequence
  Galanin Message Associated Peptide  GMAP (1 - 41), synthesized
  MOD_RES (41)..(41): AMIDATION
ELEPEDEARPGGFDRLQSEDKAIRTIMEFLAFLHLKEAGAL

SEQ ID NO: 751 - protein, 26 aa, Artificial Sequence
  Galanin Message Associated Peptide  GMAP (16 - 41)
  MOD_RES (26)..(26): AMIDATION
LQSEDKAIRTIMEFLAFLHLKEAGAL

SEQ ID NO: 752 - protein, 17 aa, Artificial Sequence
  Galanin Message Associated Peptide  GMAP (25 - 41)
  MOD_RES (17)..(17): AMIDATION
TIMEFLAFLHLKEAGAL

SEQ ID NO: 753 - protein, 16 aa, Artificial Sequence
  Galanin Message Associated Peptide  GMAP (44 - 59)
  MOD_RES (16)..(16): AMIDATION
LPGLPSAASSEDAGQS

SEQ ID NO: 754 - protein, 31 aa, Artificial Sequence
  Galanin - Lys
GWTLNSAGYLLGPHAVGNHRSFSDKNGLTSK

SEQ ID NO: 755 - protein, 18 aa, Artificial Sequence
  Leptin (57 - 74)
VTGLDFIPGLHPILTLSK

SEQ ID NO: 756 - protein, 40 aa, Artificial Sequence
  GIP (3 - 42)
EGTFISDYSIAMDKIHQQDFVNWLLAQKGKKNDWKHNITQ

SEQ ID NO: 757 - protein, 17 aa, Artificial Sequence
  (Leu15) - Gastrin - 1
  MISC_FEATURE (1)..(1): Xaa = Pyroglutamic acid
  MOD_RES (17)..(17): AMIDATION
XGPWLEEEEEAYGWLDF

SEQ ID NO: 758 - protein, 34 aa, Artificial Sequence
  Big Gastrin - 1
  MISC_FEATURE (1)..(1): Xaa = Pyroglutamic acid
  MOD_RES (34)..(34): AMIDATION
XLGPQGPPHLVADPSKKQGPWLEEEEEAYGWMDF

SEQ ID NO: 759 - protein, 17 aa, Artificial Sequence
  Gastrin (1 - 17)
  MOD_RES (17)..(17): AMIDATION
EGPWLEEEEEAYGWMDF

SEQ ID NO: 760 - protein, 17 aa, Artificial Sequence
  Gastrin (1 - 17)
  MISC_FEATURE (12)..(12): Xaa = Phosphorolyated Tyrosine
  MOD_RES (17)..(17): AMIDATION
EGPWLEEEEEAXGWMDF

SEQ ID NO: 761 - protein, 27 aa, Artificial Sequence
  Gastrin Releasing Peptide
  MOD_RES (27)..(27): AMIDATION
VPLPAGGGTVLTKMYPRGNHWAVGHLM

SEQ ID NO: 762 - protein, 17 aa, Artificial Sequence
  Gastrin derived peptide
  MOD_RES (17)..(17): AMIDATION
GPWLEEEEEAYGWMDFK

SEQ ID NO: 763 - protein, 14 aa, Artificial Sequence
  Gastrin Releasing Peptide (14 - 27)
  MOD_RES (14)..(14): AMIDATION
MYPRGNHWAVGHLM

SEQ ID NO: 764 - protein, 8 aa, Artificial Sequence
  Gastrin Releasing Peptide (20 - 27)
  MOD_RES (1)..(1): ACETYLATION
  MOD_RES (8)..(8): AMIDATION
HWAVGHLM

SEQ ID NO: 765 - protein, 28 aa, Artificial Sequence
  Gastrin Releasing Peptide - Lys
VPLPAGGGTVLTKMYPRGNHWAVGHLMK

SEQ ID NO: 766 - protein, 17 aa, Artificial Sequence
  Gastrin Fragment 1
  MISC_FEATURE (1)..(1): Xaa = Pyroglutamic acid
  MOD_RES (17)..(17): AMIDATION
XGPWLEEEEEAYGWMDF

SEQ ID NO: 767 - protein, 17 aa, Artificial Sequence
  Gastrin - Releasing Peptide (1 - 17)
VPLPAGGGTVLTKMYPR

SEQ ID NO: 768 - protein, 10 aa, Artificial Sequence
  GRP10  Gastrin - releasing Peptide 10 / Neuromedin C
  MOD_RES (10)..(10): AMIDATION
GNHWAVGHLM

SEQ ID NO: 769 - protein, 28 aa, Artificial Sequence
  {Des - His1  Glu9} - Glucagon (1 - 29)
  MOD_RES (28)..(28): AMIDATION
SQGTFTSEYSKYLDSRRAQDFVQWLMNT

SEQ ID NO: 770 - protein, 27 aa, Artificial Sequence
  Peptide Histidine Isoleucinamide (PHI)  Porcine (1 - 27)
  MOD_RES (27)..(27): AMIDATION
HADGVFTSDFSRLLGQLSAKKYLESLI

SEQ ID NO: 771 - protein, 12 aa, Artificial Sequence
  Glucagon - Like Peptide 1  GLP - 1 (7 - 17) - Cys
HAEGTFTSDVSC

SEQ ID NO: 772 - protein, 15 aa, Artificial Sequence
  {GalNAc - Ser} - Erythropoietin (Epo) (117 - 131)
  MISC_FEATURE (10)..(10): Xaa = GalNAc labeled Serine
EAISPPDAAXAAPLR

SEQ ID NO: 773 - protein, 13 aa, Artificial Sequence
  EGFR - 1148  EGFR (1140 - 1152)
QISLDNPDYQQDF

SEQ ID NO: 774 - protein, 29 aa, Artificial Sequence
  Growth Hormone Releasing Factor  GRF (1 - 29)
  MOD_RES (29)..(29): AMIDATION
YADAIFTNSYRKVLGQLSARKLLQDIMSR

SEQ ID NO: 775 - protein, 40 aa, Artificial Sequence
  Growth Hormone Releasing Factor  GRF (1 - 40)
  MOD_RES (40)..(40): AMIDATION
YADAIFTNSYRKVLGQLSARKLLQDIMSRQQGESNQERGA

SEQ ID NO: 776 - protein, 44 aa, Artificial Sequence; identical to SEQ ID NO: 1
  Growth Hormone Releasing Factor  GRF (1 - 44)
  MOD_RES (44)..(44): AMIDATION

SEQ ID NO: 777 - protein, 29 aa, Artificial Sequence
  {D - Ala2} - Growth Hormone Releasing Factor  GRF (1 - 29)
  MISC_FEATURE (2)..(2): Xaa = D - Alanine
  MOD_RES (29)..(29): AMIDATION
YXDAIFTNSYRKVLGQLSARKLLQDIMSR

SEQ ID NO: 778 - protein, 31 aa, Artificial Sequence
  PEP1
  MOD_RES (31)..(31): AMIDATION
SGSWLRDVWDWICTVLTDFKTWLQSKLDYKD

SEQ ID NO: 779 - protein, 14 aa, Artificial Sequence
  Pep 4A
  MOD_RES (14)..(14): AMIDATION
GSVVIVGRIILSGR

SEQ ID NO: 780 - protein, 17 aa, Artificial Sequence
  Pep 4AK
  MOD_RES (17)..(17): AMIDATION
KKKGSVVIVGRIILSGR

SEQ ID NO: 781 - protein, 12 aa, Artificial Sequence
  HMGA N - Terminal Fragment
GAGQPSTSAQGQ

SEQ ID NO: 782 - protein, 14 aa, Artificial Sequence
  AKT/PKB/Rac - Protein Kinase Substrate {ARKRERTYSFGHHA}
ARKRERTYSFGHHA

SEQ ID NO: 783 - protein, 14 aa, Artificial Sequence
  TMR
ARKRERTYSFGHHA

SEQ ID NO: 784 - protein, 36 aa, Artificial Sequence
  T20
  MOD_RES (1)..(1): ACETYLATION
  MOD_RES (36)..(36): AMIDATION
YTSLIHSLIEESQNQQEKNEQELLELDKWASLWNWF

SEQ ID NO: 785 - protein, 18 aa, Artificial Sequence
  T22 ({Tyr5 12  Lys7} - polyphemusin II)
RRWCYRKCYKGYCYRKCR

SEQ ID NO: 786 - protein, 20 aa, Artificial Sequence
  Skeletal Dihydropyridine Receptor (671 - 690)
TSAQKAKAEERKRRKMSRGL

SEQ ID NO: 787 - protein, 10 aa, Acipenser gueldenstaedtii
  MISC_FEATURE (1)..(1): Xaa = Pyroglutamic acid
  MOD_RES (10)..(10): AMIDATION
XHWSYGLRPG

SEQ ID NO: 788 - protein, 22 aa, homo sapiens
AEKKDEGPYRMEHFRWGSPPKD

SEQ ID NO: 789 - protein, 12 aa, Artificial Sequence
  Gamma - 2 - MSH (41 - 58)
YVMGHFRWDRFG

SEQ ID NO: 790 - protein, 13 aa, Artificial Sequence
  {D - Phe7} - ACTH  Alpha - MSH (1 - 13)
  MISC_FEATURE (7)..(7): Xaa = d-Phenylalanine
  MOD_RES (13)..(13): AMIDATION
SYSMEHXRWGKPV

SEQ ID NO: 791 - protein, 13 aa, Artificial Sequence
  {Nle4  D - Phe7} - Alpha - MSH
  MOD_RES (1)..(1): ACETYLATION
  MISC_FEATURE (4)..(4): Xaa = Noraleucine
  MISC_FEATURE (7)..(7): Xaa = d-Phenylalanine
  MOD_RES (13)..(13): AMIDATION
SYSXEHXRWGKPV

SEQ ID NO: 792 - protein, 19 aa, Artificial Sequence
  Melanin Concentrating Hormone
  DISULFID (7)..(16): Disulfide Bond
DFDMLRCMLGRVYRPCWQV

SEQ ID NO: 793 - protein, 24 aa, Artificial Sequence
  VA -  - MSH  Lipotropin - _  Proopiomelanocortin
VAAEKKDEGPYRMEHFRWGSPPKD

SEQ ID NO: 794 - protein, 20 aa, Artificial Sequence
  Apolipoprotein B - 100 (3136 - 3155)
KTTKQSFDLSVKAQYKKNKH

SEQ ID NO: 795 - protein, 20 aa, Artificial Sequence
  alpha - 9 Gliadin Peptide
QVLQQSTYQLLQELCCQHLW

SEQ ID NO: 796 - protein, 14 aa, Artificial Sequence
  MOG (8 - 21)
PGYPIRALVGDEAE

SEQ ID NO: 797 - protein, 12 aa, Artificial Sequence
  MOG (97 - 108)
TCFFRDHSYQEE

SEQ ID NO: 798 - protein, 26 aa, Artificial Sequence
  MOG (14 - 39)
ALVGDEVELPCRISPGKNATGMELGW

SEQ ID NO: 799 - protein, 24 aa, Artificial Sequence
  MOG (50 - 74)
LYRNGKDQDGDAPEYRGRTELLKD

SEQ ID NO: 800 - protein, 24 aa, Artificial Sequence [sequence omitted]

SEQ ID NO: 801 - protein, 25 aa, Artificial Sequence
  MOG (76 - 100)
IGEGKVTLRIRNVRFSDEGGFTCFF

SEQ ID NO: 802 - protein, 25 aa, Artificial Sequence
  MOG (89 - 113)
RFSDEGGFTCFFRDHSYQEEAAMEL

SEQ ID NO: 803 - protein, 17 aa, Artificial Sequence
  MOG (35 - 51)
MEVGWYRSPFSRVVHLY

SEQ ID NO: 804 - protein, 18 aa, Artificial Sequence
  MOG (35 - 52)
MEVGWYRSPFSRVVHLYR

SEQ ID NO: 805 - protein, 19 aa, Artificial Sequence
  MOG (35 - 53)
MEVGWYRSPFSRVVHLYRN

SEQ ID NO: 806 - protein, 21 aa, Artificial Sequence
  MOG (35 - 55)
MEVGWYRPPFSRVVHLYRNGK

SEQ ID NO: 807 - protein, 20 aa, Artificial Sequence
  MOG (101 - 120)
RDHSYQEEAAMELKVEDPFY

SEQ ID NO: 808 - protein, 11 aa, Artificial Sequence
  {Ala4} - MBP (1 - 11)
  MOD_RES (1)..(1): ACETYLATION
ASQARPSQRHG

SEQ ID NO: 809 - protein, 11 aa, Artificial Sequence
  {Tyr4} - MBP (1 - 11)
  MOD_RES (1)..(1): ACETYLATION
ASQYRPSQRHG

SEQ ID NO: 810 - protein, 17 aa, Artificial Sequence
  MBP (1 - 17)
ASQKRPSQRSKYLATAS

SEQ ID NO: 811 - protein, 20 aa, Artificial Sequence
  MBP (1 - 20)  Myelin Basic Protein (1 - 20)
ASQKRPSQRSKYLATASTMD

SEQ ID NO: 812 - protein, 19 aa, Artificial Sequence
  MBP (111 - 129)
LSRFSWGAEGQRPGFGYGG

SEQ ID NO: 813 - protein, 25 aa, Artificial Sequence
  MBP (131 - 155)
ASDYKSAHKGLKGVDAQGTLSKIFK

SEQ ID NO: 814 - protein, 27 aa, Artificial Sequence
  Vasonatrin Peptide (1 - 27)
  DISULFID (6)..(22): Disulfide Bond
GLSKGCFGLKLDRIGSMSGLGCNSFRY

SEQ ID NO: 815 - protein, 7 aa, Artificial Sequence
  {Ala5   - Ala8} - Neurokinin A (4 - 10)
  MISC_FEATURE (5)..(5): Xaa = beta Alaine
  MOD_RES (7)..(7): AMIDATION
DAFVXLM

SEQ ID NO: 816 - protein, 10 aa, Artificial Sequence
  {D - Pro2  D - Trp6 8  Nle10} - Neurokinin B
  MISC_FEATURE (2)..(2): Xaa = D - Tryptophan
  MISC_FEATURE (6)..(6): Xaa = D - Tryptophan
  MISC_FEATURE (8)..(8): Xaa = D - Tryptophan
  MOD_RES (10)..(10): AMIDATION
  MISC_FEATURE (10)..(10): Xaa = Noraleucine
DXHDFXVXLX

SEQ ID NO: 817 - protein, 7 aa, Artificial Sequence
  {Lys5  NMeLeu9  NIe10} - Neurokinin A (4 - 10)
  MISC_FEATURE (6)..(6): Xaa = Noraleucine
  MOD_RES (7)..(7): AMIDATION
  MISC_FEATURE (7)..(7): Xaa = Noraleucine
DKFVGXX

SEQ ID NO: 818 - protein, 10 aa, Gallus gallus
  MOD_RES (10)..(10): AMIDATION
HKTDSFVGLM

SEQ ID NO: 819 - protein, 30 aa, Artificial Sequence
  Neuromedin (B - 30)
  MOD_RES (30)..(30): AMIDATION
LSWDLPEPRSRAGKIRVHPRGNLWATGHFM

SEQ ID NO: 820 - protein, 10 aa, Artificial Sequence
  {Ser2} - Neuromedin C
  MOD_RES (10)..(10): AMIDATION
GSHWAVGHLM

SEQ ID NO: 821 - protein, 7 aa, Artificial Sequence
  Neuroprotectin (D  Ala1)
  MISC_FEATURE (1)..(1): Xaa = D - Alanine
  MOD_RES (7)..(7): AMIDATION
XDLIAYL

SEQ ID NO: 822 - protein, 28 aa, Artificial Sequence
  {Ala16 17 20} - beta - Amyloid (1 - 28)
DAEFRHDSGYEVHHQAAVFAAEDVGSNK

SEQ ID NO: 823 - protein, 18 aa, Bos taurus
  MOD_RES (18)..(18): AMIDATION
AGEGLSSPFWSLAAPQRF

SEQ ID NO: 824 - protein, 23 aa, Artificial Sequence
  Erythropoietin  Human (hEPO) Fragment
MEVGQQAVEVWQGLALLSEAVLR

SEQ ID NO: 825 - protein, 23 aa, Artificial Sequence
  Neuropeptide NPW - 23
WYKHVASPRYHTVGRAAGLLMGL

SEQ ID NO: 826 - protein, 17 aa, Artificial Sequence
  VGF Protein Precursor (491 - 507)
PPEPVPPPRAAPAPTHV

SEQ ID NO: 827 - protein, 13 aa, Artificial Sequence
  {Gln4} - Neurotensin
  MISC_FEATURE (1)..(1): Xaa = Pyroglutamic acid
XLYQNKPRRPYIL

SEQ ID NO: 828 - protein, 13 aa, Artificial Sequence
  {D - Tyr11} - Neurotensin
  MISC_FEATURE (1)..(1): Xaa = Pyroglutamic acid
  MISC_FEATURE (11)..(11): Xaa = d-Tyrosine
XLYENKPRRPXIL

SEQ ID NO: 829 - protein, 13 aa, Artificial Sequence
  {D - Trp11} - Neurotensin
  MISC_FEATURE (1)..(1): Xaa = Pyroglutamic acid
  MISC_FEATURE (11)..(11): Xaa = D - Tryptophan
XLYENKPRRPXIL

SEQ ID NO: 830 - protein, 13 aa, Artificial Sequence
  {D - Phe11} - Neurotensin
  MISC_FEATURE (1)..(1): Xaa = Pyroglutamic acid
  MISC_FEATURE (11)..(11): Xaa = d-Phenylalanine
XLYENKPRRPXIL

SEQ ID NO: 831 - protein, 13 aa, Artificial Sequence
  Neurotensin
  MISC_FEATURE (1)..(1): Xaa = Pyroglutamic acid
XLYENKPRRPYIL

SEQ ID NO: 832 - protein, 39 aa, Moniezia expansa
  MOD_RES (39)..(39): AMIDATION
PDKDFIVNPSDLVLDNKAALRDYLRQINEYFAIIGRPRF

SEQ ID NO: 833 - protein, 27 aa, Artificial Sequence
  PTD - p50 (NLS) Inhibitory Peptide
DRQIKIWFQNRRMKWKKVQRKRQKLMP

SEQ ID NO: 834 - protein, 29 aa, Artificial Sequence
  PTD - p65 - P1 Peptide
DRQIKIWFQNRRMKWKKQLRRPSDRELSE

SEQ ID NO: 835 - protein, 29 aa, Artificial Sequence
  PTD - p65 - P6 (Ser529/536) Inhibitory Peptide
DRQIKIWFQNRRMKWKKNGLLSGDEDFSS

SEQ ID NO: 836 - protein, 25 aa, Artificial Sequence
  PTD - TRAF6 Inhibitory Peptide
DRQIKIFQNRRMKWKKRKIPTEDEY

SEQ ID NO: 837 - protein, 19 aa, Artificial Sequence
  RNase S Complex Peptide
  MOD_RES (1)..(1): ACETYLATION
  MOD_RES (19)..(19): AMIDATION
KETAAAKFERQHMDSSTSA

SEQ ID NO: 838 - protein, 28 aa, Artificial Sequence
  IKK_ NEMO Binding Domain (NBD) Inhibitory Peptide
DRQIKIWFQNRRMKWKKTALDWSWLQTE

SEQ ID NO: 839 - protein, 5 aa, Artificial Sequence
  {Trp5} - Oryzatensin (5 - 9)
WPLPR

SEQ ID NO: 840 - protein, 9 aa, Artificial Sequence
  LVV - Hemorphin - 6  Leu - Valorphin - Arg
LVVYPWTQR

SEQ ID NO: 841 - protein, 10 aa, Artificial Sequence
  LVV - Hemorphin - 7
LVVYPWTQRF

SEQ ID NO: 842 - protein, 11 aa, Artificial Sequence
  Nociceptin (1 - 11)
FGGFTGARKSA

SEQ ID NO: 843 - protein, 13 aa, Artificial Sequence
  Nociceptin (1 - 13)
FGGFTGARKSARK

SEQ ID NO: 844 - protein, 7 aa, Artificial Sequence
  Nociceptin (1 - 7)
FGGFTGA

SEQ ID NO: 845 - protein, 8 aa, Artificial Sequence
  Prepronociceptin (169 - 176)
TLHQNGNV

SEQ ID NO: 846 - protein, 6 aa, Artificial Sequence
  Serorphin  BSA (399 - 404)
YGFQNA

SEQ ID NO: 847 - protein, 7 aa, Artificial Sequence
  Valorphin
VVYPWTQ

SEQ ID NO: 848 - protein, 33 aa, Bos taurus
  MISC_FEATURE (1)..(1): Xaa = Pyroglutamic acid
  DISULFID (6)..(12): Disulfide Bond
  DISULFID (7)..(14): Disulfide Bond
  MOD_RES (33)..(33): AMIDATION
XPLPDCCRQKTCSCRLYELLHGAGNHAAGILTL

SEQ ID NO: 849 - protein, 28 aa, Artificial Sequence
  Orexin B
  MOD_RES (28)..(28): AMIDATION
RSGPPGLQGRLQRLLQASGNHAAGILTM

SEQ ID NO: 850 - protein, 28 aa, homo sapiens
  MOD_RES (28)..(28): AMIDATION
FSGPPGLQGRLQRLLQASGNHAAGILTM

SEQ ID NO: 851 - protein, 48 aa, Artificial Sequence
  {Gla17 21 24} - Osteocalcin (1 - 49)
  MISC_FEATURE (17)..(17): Xaa = Gamma Carboxyglutamic Acid
  MISC_FEATURE (21)..(21): Xaa = Gamma Carboxyglutamic Acid
  DISULFID (23)..(29): Disulfide Bond
  MISC_FEATURE (24)..(24): Xaa = Gamma Carboxyglutamic Acid
YLYQWLGAPVPYPDPLXPRRXVCXLNPDCDELDHIGFQEAYRRFYGPV

SEQ ID NO: 852 - protein, 13 aa, Artificial Sequence
  Osteocalcin (37 - 49)
GFQEAYRRFYGPV

SEQ ID NO: 853 - protein, 13 aa, Artificial Sequence
  Osteocalcin (7 - 19)
GAPVPYPDPLEPR

SEQ ID NO: 854 - protein, 9 aa, Artificial Sequence
  Lys - OVA (257 - 264)  KSIINFEKL
KSIINFEKL

SEQ ID NO: 855 - protein, 9 aa, Artificial Sequence
  {Arg8} - Vasopressin (AVP)
  DISULFID (1)..(6): Disulfide Bond
  MOD_RES (9)..(9): AMIDATION
CYFQNCPRG

SEQ ID NO: 856 - protein, 9 aa, Artificial Sequence
  {Deamino - Cys1  D - Arg8} - Vasopressin  free acid
  MISC_FEATURE (1)..(1): Xaa = 3 - Mercaptopropionyl Cystine
  DISULFID (1)..(6): Disulfide Bond
  MISC_FEATURE (8)..(8): Xaa = D - Arginine
XYFQNCPXG

SEQ ID NO: 857 - protein, 9 aa, Artificial Sequence
  Oxytocin
  DISULFID (1)..(6): Disulfide Bond
  MOD_RES (9)..(9): AMIDATION
CYIQNCPLG

SEQ ID NO: 858 - protein, 25 aa, Artificial Sequence
  Serum Albumin (102 - 226)
ADDKETCFAEEGKKLVAASQAALGL

SEQ ID NO: 859 - protein, 8 aa, Artificial Sequence
  Apolipoprotein J (215 - 222)
RPHFFFPK

SEQ ID NO: 860 - protein, 11 aa, Artificial Sequence
  Apolipoprotein L (306 - 316)
VNEPSILEMSR

SEQ ID NO: 861 - protein, 20 aa, Artificial Sequence
  Catestatin
SSMKLSFRARAYGFRGPGPL

SEQ ID NO: 862 - protein, 20 aa, homo sapiens
SSMKLSFRARAYGFRGPGPQ

SEQ ID NO: 863 - protein, 16 aa, Artificial Sequence
  Pancreastatin (37 - 52)
  MOD_RES (16)..(16): AMIDATION
EEEEEMAVVPQGLFRG

SEQ ID NO: 864 - protein, 24 aa, Artificial Sequence
  Pancreatic Polypeptide (30 - 53)
APLEPVYPGDNATPEQMAQYAADL

SEQ ID NO: 865 - protein, 41 aa, Artificial Sequence
  {Tyr0} - Hypercalcemia Malignancy Factor (1 - 40)
YAVSEHQLLHDKGKSIQDLRRRFFLHHLIAEIHTAEIRATS

SEQ ID NO: 866 - protein, 34 aa, homo sapiens
  MOD_RES (34)..(34): AMIDATION
AVSEHQLLHDKGKSIQDLRRRFFLHHLIAEIHTA

SEQ ID NO: 867 - protein, 29 aa, Artificial Sequence
  PACAP - Related Peptide (PRP)
DVAHGILNEAYRKVLDQLSAGKHLQSLVA

SEQ ID NO: 868 - protein, 31 aa, Artificial Sequence
  Prolactin Releasing Peptide (1 - 31)
  MOD_RES (31)..(31): AMIDATION
SRTHRHSMEIRTPDINPAWYASRGIRPVGRF

SEQ ID NO: 869 - protein, 20 aa, Artificial Sequence
  Prolactin Releasing Peptide (12 - 31)
  MOD_RES (20)..(20): AMIDATION
TPDINPAWYASRGIRPVGRF

SEQ ID NO: 870 - protein, 27 aa, Artificial Sequence
  Calpain Inhibitor Peptide  B27 - WT
DPMSSTYIEELGKREVTIPPKYRELLA

SEQ ID NO: 871 - protein, 27 aa, Artificial Sequence
  Acetyl - Calpastatin (184 - 210)
  MOD_RES (1)..(1): ACETYLATION
  MOD_RES (27)..(27): AMIDATION
DPMSSTYIEELGKREVTIPPKYRELLA

SEQ ID NO: 872 - protein, 13 aa, Artificial Sequence
  {Ala144} - PLP (139 - 151) A144 - PLP(139 - 151)
HSLGKALGHPDKF

SEQ ID NO: 873 - protein, 20 aa, Artificial Sequence
  PLP (190 - 209)
SKTSASIGSLCADARMYGVL

SEQ ID NO: 874 - protein, 22 aa, Artificial Sequence
  PLP (48 - 70)
TYFSKNYQDYEYLINIHAFQYV

SEQ ID NO: 875 - protein, 14 aa, Artificial Sequence
  Acetyl - Tetradecapeptide Renin Substrate  Acetyl - Angiotensinogen (1 - 14)
  MOD_RES (1)..(1): ACETYLATION
DRVYIHPFHLVIHN

SEQ ID NO: 876 - protein, 23 aa, Artificial Sequence
  TP508  Thrombin
AGYKPDEGKRGDACEGDSGGPFV

SEQ ID NO: 877 - protein, 28 aa, Artificial Sequence
  Salusin - alpha
  MOD_RES (28)..(28): AMIDATION
SGALPPAPAAPRPALRAQRAGPAGPGAK

SEQ ID NO: 878 - protein, 20 aa, Artificial Sequence
  Salusin - beta
AIFIFIRWLLKLGHHGRAPP

SEQ ID NO: 879 - protein, 22 aa, Artificial Sequence
  Prosaptide 769P (D -Ala2)
  MISC_FEATURE (2)..(2): Xaa = D - Alanine
CXFLVKEVTKLIDNNKTEKEIL

SEQ ID NO: 880 - protein, 14 aa, Artificial Sequence
  Prosaptide TX14(A) (D -Ala2)
  MISC_FEATURE (2)..(2): Xaa = D - Alanine
TXLIDNNATEEILY

SEQ ID NO: 881 - protein, 14 aa, Artificial Sequence
  Prosaptide  wild type
TKLIDNNKTEKEIL

SEQ ID NO: 882 - protein, 12 aa, Artificial Sequence
  Saposin C12
LIDNNKTEKEIL

SEQ ID NO: 883 - protein, 18 aa, Artificial Sequence
  Saposin C18
VKEVTKLIDNNKTEKEIL

SEQ ID NO: 884 - protein, 22 aa, Artificial Sequence
  Saposin C22
CEFLVKEVTKLIDNNKTEKEIL

SEQ ID NO: 885 - protein, 27 aa, homo sapiens
  MOD_RES (27)..(27): AMIDATION
HSDGTFTSELSRLREGARLQRLLQGLV

SEQ ID NO: 886 - protein, 30 aa, Artificial Sequence
  CC Chemokine Receptor 3 Fragment I  amide
  MOD_RES (30)..(30): AMIDATION
MTTSLDTVETFGTTSYYDDVGLLCEKADTR

SEQ ID NO: 887 - protein, 24 aa, Artificial Sequence
  CC Chemokine Receptor 3 Fragment II
MTTSLDTVETFGTTSYYDDVGLLC

SEQ ID NO: 888 - protein, 16 aa, Artificial Sequence
  DAP10 Signaling Fragment
PAQEDGKVYINMPGRG

SEQ ID NO: 889 - protein, 18 aa, Artificial Sequence
  Erythropoietin - Mimetic Peptide 17 (EMP17)
TYSCHFGPLTWVCKPQGG

SEQ ID NO: 890 - protein, 11 aa, Artificial Sequence
  Hsp Heat shock protein (3 - 13)
KTIAYDEEARR

SEQ ID NO: 891 - protein, 25 aa, Artificial Sequence
  iNOS (507 - 531)
RPKRREIPLKVLVKAVLFACMLMRK

SEQ ID NO: 892 - protein, 18 aa, Artificial Sequence
  Notch 1 (1735 - 1752)
VLLFFVGCGVLLSRKRRR

SEQ ID NO: 893 - protein, 20 aa, Artificial Sequence
  SmMLCKp  Smooth - Muscle Myosin Light - Chain Kinase (796 - 815) Calmodulin Binding
ARRKWQKTGHAVRAIGRLSS

SEQ ID NO: 894 - protein, 16 aa, Artificial Sequence
  Tau - Protein (1 - 16)
MAEPRQEFEVMEDHAG

SEQ ID NO: 895 - protein, 13 aa, Artificial Sequence
  Tau - Protein (323 - 335)
GSLGNIHHKPGGG

SEQ ID NO: 896 - protein, 20 aa, Artificial Sequence
  Caveolin - 1 Scaffolding Domain (82 - 101)
DGIWKASFTTFTVTKYWFYR

SEQ ID NO: 897 - protein, 20 aa, Artificial Sequence
  Caveolin - 3 (Cav - 3)  (55 - 74)
DGVWRVSYTTFTVSKYWCYR

SEQ ID NO: 898 - protein, 42 aa, Artificial Sequence
  {Gly35  Asp37} - beta - Amyloid (1 - 42)
DAEFRHDSGYEVHHQKLVFFAEDVGSNKGAIIGLGVDGVVIA

SEQ ID NO: 899 - protein, 40 aa, Artificial Sequence
  {Cys7} - beta - Amyloid (1 - 40)
DAEFRHCSGYEVHHQKLVFFAEDVGSNKGAIIGLMVGGVV

SEQ ID NO: 900 - protein, 40 aa, Artificial Sequence
  beta - Amyloid (1 - 40)
DAEFRHDSGYEVHHQKLVFFAEDVGSNKGAIIGLMVGGVV

SEQ ID NO: 901 - protein, 11 aa, Artificial Sequence
  {Cys3 6  Tyr8  Pro9} - Substance P
  DISULFID (3)..(6): Disulfide Bond
  MOD_RES (11)..(11): AMIDATION
RPCPQCFYPLM

SEQ ID NO: 902 - protein, 11 aa, Artificial Sequence
  {4 - Chloro - Phe}7 8 - Substance P
  MISC_FEATURE (7)..(7): Xaa = d-para-Chloro-Phenylalanine
  MISC_FEATURE (8)..(8): Xaa = d-para-Chloro-Phenylalanine
  MOD_RES (11)..(11): AMIDATION
RPKPQQXXGLM

SEQ ID NO: 903 - protein, 11 aa, Artificial Sequence
  {Cys3 6  Tyr8  Pro10} - Substance P
  DISULFID (3)..(6): Disulfide Bond
  MOD_RES (11)..(11): AMIDATION
RPCPQCFYGPM

SEQ ID NO: 904 - protein, 11 aa, Pelophylax ridibundus
  MOD_RES (11)..(11): AMIDATION
KPNPERFYGLM

SEQ ID NO: 905 - protein, 10 aa, Scyliorhinus canicula
AKFDKFYGLM

SEQ ID NO: 906 - protein, 11 aa, Cavia porcellus
  MOD_RES (11)..(11): AMIDATION
RPKPQQFFGLM

SEQ ID NO: 907 - protein, 14 aa, Artificial Sequence
  human Thrombin Receptor 42 - 55
SFLLRNPNDKYEPF

SEQ ID NO: 908 - protein, 20 aa, Artificial Sequence
  Tumor Necrosis Factor Receptor  TNFR (159 - 178) Analog
QEKQNTVATAHGFFLRENEG

SEQ ID NO: 909 - protein, 19 aa, Artificial Sequence
  CDIP2
KISLQRLKSYVITTSRCPQ

SEQ ID NO: 910 - protein, 12 aa, Artificial Sequence
  Pro - TNF - _ (71 - 82)
SPLAQAVRSSSR

SEQ ID NO: 911 - protein, 27 aa, Artificial Sequence
  TNF - _ (10 - 36)
DKPVAHVVANPQAEGQLQWLNRRANAL

SEQ ID NO: 912 - protein, 15 aa, Artificial Sequence
  TNF - _ (31 - 45)
RRANALLANGVELRD

SEQ ID NO: 913 - protein, 33 aa, Pelophylax ridibundus
  DISULFID (27)..(33): Disulfide Bond
GIMDTLKNLAKTAGKGALQSLLNHASCKLSGQC

SEQ ID NO: 914 - protein, 33 aa, Artificial Sequence
  Brevinin - 2Eh
  DISULFID (27)..(33): Disulfide Bond
GIMDTLKNLAKTAGKGALQSLLNHASCKLSKQC

SEQ ID NO: 915 - protein, 15 aa, Artificial Sequence
  Caloxin 1b1
TAWSEVLHLLSRGGG

SEQ ID NO: 916 - protein, 15 aa, Artificial Sequence
  Caloxin 2A1
VSNSNWPSFPSSGGG

SEQ ID NO: 917 - protein, 20 aa, Artificial Sequence
  Caloxin 3A1
WSSTSSVSAPLEFGGGGSAK

SEQ ID NO: 918 - protein, 26 aa, Staphylococcus aureus
MAQDIISTIGDLVKWIIDTVNKFTKK

SEQ ID NO: 919 - protein, 16 aa, Artificial Sequence
  Delta - Toxin (5 - 20)
IISTIGDLVKWIIDTV

SEQ ID NO: 920 - protein, 21 aa, Artificial Sequence
  Sarafotoxin 6c
  DISULFID (1)..(15): Disulfide Bond
  DISULFID (3)..(11): Disulfide Bond
CTCNDMTDEECLNFCHQDVIW

SEQ ID NO: 921 - protein, 35 aa, Rattus norvegicus
LSELDDRADALQAGASQFETSAAKLKRKYWWKNLK

SEQ ID NO: 922 - protein, 20 aa, Artificial Sequence
  Vesicle - Associated Membrane Protein  VAMP (77 - 94)
SQFETSAAKLKRKYWWKNLK

SEQ ID NO: 923 - protein, 35 aa, Artificial Sequence
  Helodermin
HSDAIFTQQYSKLLAKLALQKYLASILGSRTSPPP

SEQ ID NO: 924 - protein, 30 aa, Artificial Sequence
  highly selective CRF2 receptor antagonist K41498
  MISC_FEATURE (1)..(1): Xaa = d-Phenylalanine
  MISC_FEATURE (7)..(7): Xaa = Noraleucine
  MOD_RES (30)..(30): AMIDATION
XHLLRKXIEIEKQEKEKQQAANNRLLLDTI

SEQ ID NO: 925 - protein, 33 aa, Artificial Sequence
  Corticotropin-releasing factor receptor antagonist
  MOD_RES (33)..(33): AMIDATION
DLTFHLLREMLEMAKAEQEAEQAALNRLLLEEA

SEQ ID NO: 926 - protein, 30 aa, Artificial Sequence
  Astressin  CAS No: {170809-51-5}
  MISC_FEATURE (1)..(1): Xaa = d-Phenylalanine
  MISC_FEATURE (10)..(10): Xaa = Noraleucine
  MISC_FEATURE (19)..(19): Xaa = gamma-Glu Cyclized with epsilon-Lys
  MISC_FEATURE (22)..(22): Xaa = epsilon-Lys Cyclized with gamma-Glu
  MISC_FEATURE (27)..(27): Xaa = Noraleucine
  MOD_RES (30)..(30): AMIDATION
XHLLREVLEXARAEQLAQXAHXNRKLXEII

SEQ ID NO: 927 - protein, 38 aa, Artificial Sequence
  Stressin I
  MOD_RES (1)..(1): ACETYLATION
  MISC_FEATURE (18)..(18): Xaa = Noraleucine
  MISC_FEATURE (28)..(28): Xaa = gamma-Glu Cyclized with epsilon-Lys
  MISC_FEATURE (31)..(31): Xaa = epsilon-Lys Cyclized with gamma-Glu
  MISC_FEATURE (35)..(35): Xaa = Noraleucine
  MOD_RES (38)..(38): AMIDATION
PPISLDLTFHLLREVLEXARAEQLAQQXHSXAKLXEII

SEQ ID NO: 928 - protein, 161 aa, homo sapiens
MLMPVHFLLLLLLLLGGPRTGLPHKFYKAKPIFSCLNTALSEAEKGQWEDASLLSKRSFHYLRSRDASSGEEEEGKEKKTFPISGARGGAGGTRYRYVSQAQPRGKPRQDTAKSPHRTKFTLSLDVPTNIMNLLFNIAKAKNLRAQAAANAHLMAQIGRKK

SEQ ID NO: 929 - protein, 56 aa, Artificial Sequence
  Active Form: 120-137 urocortin III
FTLSLDVPTNIMNLLFNIFTLSLDVPTNIMNLLFNIAKAKNLRAQAAANAHLMAQI

SEQ ID NO: 930 - protein, 38 aa, homo sapiens
IVLSLDVPIGLLQILLEQARARAAREQATTNARILARV

SEQ ID NO: 931 - protein, 37 aa, Artificial Sequence
  CGRP
  DISULFID (2)..(7): Disulfide Bond
  MOD_RES (37)..(37): AMIDATION
SCNTATCVTHRLAGLLSRSGGVVKDNFVPTNVGSEAF

SEQ ID NO: 932 - protein, 36 aa, Artificial Sequence
  PTHrP (Human) 1-37
AVSEHQLLHDKGKSIQDLRRFFLHHLIAEIHTAEIR

SEQ ID NO: 933 - protein, 33 aa, Artificial Sequence
  PTH (human) 1-34
SVSEIQLMHNLGKHLNSMERVEWLRKKLQDVHN

SEQ ID NO: 934 - protein, 39 aa, Artificial Sequence
  TIP 39  Tuberoinfundibular Neuropeptide
SLALADDAAFRERARLLAALERRRWLDSYMQKLLLLDAP

SEQ ID NO: 935 - protein, 15 aa, Artificial Sequence
  AF 12198
  MOD_RES (1)..(1): ACETYLATION
  MISC_FEATURE (10)..(10): Xaa = 2-aminocyclopentanecarboxylic Acid
  MOD_RES (15)..(15): AMIDATION
FEWTPGWYQXYALPL

SEQ ID NO: 936 - protein, 53 aa, homo sapiens
NSDSECPLSHDGYCLHDGVCMYIEALDKYACNCVVGYIGERCQYRDLKWWELR

SEQ ID NO: 937 - protein, 36 aa, Artificial Sequence
  {cPP1-7 NPY19-23 Ala31 Aib32 Gln34} - hPancreatic Polypeptide
  MOD_RES (32)..(32): Xaa = AIB
  MOD_RES (36)..(36): AMIDATION
GPSQPTYPGDNATPEQMARYYSALRRYINMAXRQRY

SEQ ID NO: 938 - protein, 8 aa, Artificial Sequence
  Xenin 8
HPKRPWIL

SEQ ID NO: 939 - protein, 1210 aa, homo sapiens [sequence omitted]

SEQ ID NO: 940 - protein, 705 aa, homo sapiens
MRPSGTAGAALLALLAALCPASRALEEKKVCQGTSNKLTQLGTFEDHFLSLQRMFNNCEVVLGNLEITYVQRNYDLSFLKTIQEVAGYVLIALNTVERIPLENLQIIRGNMYYENSYALAVLSNYDANKTGLKELPMRNLQEILHGAVRFSNNPALCNVESIQWRDIVSSDFLSNMSMDFQNHLGSCQKCDPSCPNGSCWGAGEENCQKLTKIICAQQCSGRCRGKSPSDCCHNQCAAGCTGPRESDCLVCRKFRDEATCKDTCPPLMLYNPTTYQMDVNPEGKYSFGATCVKKCPRNYVVTDHGSCVRACGADSYEMEEDGVRKCKKCEGPCRKVCNGIGIGEFKDSLSINATNIKHFKNCTSISGDLHILPVAFRGDSFTHTPPLDPQELDILKTVKEITGFLLIQAWPENRTDLHAFENLEIIRGRTKQHGQFSLAVVSLNITSLGLRSLKEISDGDVIISGNKNLCYANTINWKKLFGTSGQKTKIISNRGENSCKATGQVCHALCSPEGCWGPEPRDCVSCRNVSRGRECVDKCNLLEGEPREFVENSECIQCHPECLPQAMNITCTGRGPDNCIQCAHYIDGPHCVKTCPAGVMGENNTLVWKYADAGHVCHLCHPNCTYGPGNESLKAMLFCLFKLSSCNQSNDGSVSHQSGSPAAQESCLGWIPSLLPSEFQLGWGGCSHLHAWPSASVIITASSCH

SEQ ID NO: 941 - protein, 628 aa, Artificial Sequence
  epidermal growth factor receptor isoform b precursor
MRPSGTAGAALLALLAALCPASRALEEKKVCQGTSNKLTQLGTFEDHFLSLQRMFNNCEVVLGNLEITYVQRNYDLSFLKTIQEVAGYVLIALNTVERIPLENLQIIRGNMYYENSYALAVLSNYDANKTGLKELPMRNLQEILHGAVRFSNNPALCNVESIQWRDIVSSDFLSNMSMDFQNHLGSCQKCDPSCPNGSCWGAGEENCQKLTKIICAQQCSGRCRGKSPSDCCHNQCAAGCTGPRESDCLVCRKFRDEATCKDTCPPLMLYNPTTYQMDVNPEGKYSFGATCVKKCPRNYVVTDHGSCVRACGADSYEMEEDGVRKCKKCEGPCRKVCNGIGIGEFKDSLSINATNIKHFKNCTSISGDLHILPVAFRGDSFTHTPPLDPQELDILKTVKEITGFLLIQAWPENRTDLHAFENLEIIRGRTKQHGQFSLAVVSLNITSLGLRSLKEISDGDVIISGNKNLCYANTINWKKLFGTSGQKTKIISNRGENSCKATGQVCHALCSPEGCWGPEPRDCVSCRNVSRGRECVDKCNLLEGEPREFVENSECIQCHPECLPQAMNITCTGRGPDNCIQCAHYIDGPHCVKTCPAGVMGENNTLVWKYADAGHVCHLCHPNCTYGS

SEQ ID NO: 942 - protein, 405 aa, homo sapiens
MRPSGTAGAALLALLAALCPASRALEEKKVCQGTSNKLTQLGTFEDHFLSLQRMFNNCEVVLGNLEITYVQRNYDLSFLKTIQEVAGYVLIALNTVERIPLENLQIIRGNMYYENSYALAVLSNYDANKTGLKELPMRNLQEILHGAVRFSNNPALCNVESIQWRDIVSSDFLSNMSMDFQNHLGSCQKCDPSCPNGSCWGAGEENCQKLTKIICAQQCSGRCRGKSPSDCCHNQCAAGCTGPRESDCLVCRKFRDEATCKDTCPPLMLYNPTTYQMDVNPEGKYSFGATCVKKCPRNYVVTDHGSCVRACGADSYEMEEDGVRKCKKCEGPCRKVCNGIGIGEFKDSLSINATNIKHFKNCTSISGDLHILPVAFRGDSFTHTPPLDPQELDILKTVKEITGLS

SEQ ID NO: 943 - protein, 27 aa, homo sapiens
  MOD_RES (27)..(27): AMIDATION
HADGVFTSDFSKLLGQLSAKKYLESLM

SEQ ID NO: 944 - protein, 38 aa, Artificial Sequence
  Calcitoninreceptor-stimulating peptide-1
  MOD_RES (38)..(38): AMIDATION
SCNTATCMTHRLVGLLSRSGSMVRSNLLPTKMGFKVFG

SEQ ID NO: 945 - protein, 25 aa, Artificial Sequence
  AC 187 - amylin receptor antagonist
  MOD_RES (1)..(1): ACETYLATION
  MOD_RES (25)..(25): AMIDATION
VLGKLSQQLHKLQTYPRTNTGSNTY

SEQ ID NO: 946 - protein, 28 aa, Cavia porcellus
  MOD_RES (28)..(28): AMIDATION
HSDALFTDTYTRLRKQMAMKKYLNSVLN

SEQ ID NO: 947 - protein, 28 aa, Artificial Sequence
  {Ala2 8 9 11 19 22 24 25 27 28}-VIP
  MOD_RES (28)..(28): AMIDATION
HADAVFTAAYARLRKQMAAKKALAAIAA

SEQ ID NO: 948 - protein, 29 aa, Artificial Sequence
  {Ac-Tyr1 D-Phe2}GRF 1-29  amide
  MOD_RES (1)..(1): ACETYLATION
  MISC_FEATURE (2)..(2): Xaa = d-Phenylalanine
  MOD_RES (29)..(29): AMIDATION
YXDAIFTNSYRKVLGQLSARKLLQDIMSR

SEQ ID NO: 949 - protein, 23 aa, Artificial Sequence
  VIP (6-28) antagonist
  MOD_RES (23)..(23): AMIDATION
FTDNYTRLRKQMAVKKYLNSILN

SEQ ID NO: 950 - protein, 28 aa, Artificial Sequence
  {D-p-Cl-Phe6 Leu17}-VIP
  MOD_RES (28)..(28): AMIDATION
HSDAVFTDNYTRLRKQLAVKKYLNSILN

SEQ ID NO: 951 - protein, 13 aa, Artificial Sequence
  Neurotensin
  MISC_FEATURE (1)..(1): Xaa = Pyroglutamic acid
  MISC_FEATURE (4)..(4): Xaa = Phosphorolyated Tyrosine
XLYXNKPRRPYIL

SEQ ID NO: 952 - protein, 36 aa, Macaca mulatta
APLEPVYPGDNATPEQMAQYAADLRRYINMLTRPRY

SEQ ID NO: 953 - protein, 9 aa, Artificial Sequence
  Kinetensin
IARRHPYFL

SEQ ID NO: 954 - protein, 6 aa, Artificial Sequence
  JMV 449
  MISC_FEATURE (1)..(1): Xaa = Lys-1 - Lys-2 peptide bond replace with Psi(CH2-NH)
  MISC_FEATURE (2)..(2): Xaa = Lys-1 - Lys-2 peptide bond replace with Psi(CH2-NH)
XXPYIL

SEQ ID NO: 955 - protein, 6 aa, Artificial Sequence
  Neuromedin N
KIPYIL

SEQ ID NO: 956 - protein, 30 aa, Artificial Sequence
  Antisauvagine-30
  MISC_FEATURE (1)..(1): Xaa = d-Phenylalanine
  MOD_RES (30)..(30): AMIDATION
XHLLRKMIEIEKQEKEKQQAANNRLLLDTI

SEQ ID NO: 957 - protein, 412 aa, homo sapiens
MTDRQTDTAPSPSYHLLPGRRRTVDAAASRGQGPEPAPGGGVEGVGARGVALKLFVQLLGCSRFGGAVVRAGEAEPSGAARSASSGREEPQPEEGEEEEEKEEERGPQWRLGARKPGSWTGEAAVCADSAPAARAPQALARASGRGGRVARRGAEESGPPHSPSRRGSASRAGPGRASETMNFLLSWVHWSLALLLYLHHAKWSQAAPMAEGGGQNHHEVVKFMDVYQRSYCHPIETLVDIFQEYPDEIEYIFKPSCVPLMRCGGCCNDEGLECVPTEESNITMQIMRIKPHQGQHIGEMSFLQHNKCECRPKKDRARQEKKSVRGKGKGQKRKRKKSRYKSWSVYVGARCCLMPWSLPGPHPCGPCSERRKHLFVQDPQTCKCSCKNTDSRCKARQLELNERTCRCDKPRR

SEQ ID NO: 958 - protein, 395 aa, homo sapiens
MTDRQTDTAPSPSYHLLPGRRRTVDAAASRGQGPEPAPGGGVEGVGARGVALKLFVQLLGCSRFGGAVVRAGEAEPSGAARSASSGREEPQPEEGEEEEEKEEERGPQWRLGARKPGSWTGEAAVCADSAPAARAPQALARASGRGGRVARRGAEESGPPHSPSRRGSASRAGPGRASETMNFLLSWVHWSLALLLYLHHAKWSQAAPMAEGGGQNHHEVVKFMDVYQRSYCHPIETLVDIFQEYPDEIEYIFKPSCVPLMRCGGCCNDEGLECVPTEESNITMQIMRIKPHQGQHIGEMSFLQHNKCECRPKKDRARQEKKSVRGKGKGQKRKRKKSRYKSWSVPCGPCSERRKHLFVQDPQTCKCSCKNTDSRCKARQLELNERTCRCDKPRR

SEQ ID NO: 959 - protein, 389 aa, homo sapiens
MTDRQTDTAPSPSYHLLPGRRRTVDAAASRGQGPEPAPGGGVEGVGARGVALKLFVQLLGCSRFGGAVVRAGEAEPSGAARSASSGREEPQPEEGEEEEEKEEERGPQWRLGARKPGSWTGEAAVCADSAPAARAPQALARASGRGGRVARRGAEESGPPHSPSRRGSASRAGPGRASETMNFLLSWVHWSLALLLYLHHAKWSQAAPMAEGGGQNHHEVVKFMDVYQRSYCHPIETLVDIFQEYPDEIEYIFKPSCVPLMRCGGCCNDEGLECVPTEESNITMQIMRIKPHQGQHIGEMSFLQHNKCECRPKKDRARQEKKSVRGKGKGQKRKRKKSRPCGPCSERRKHLFVQDPQTCKCSCKNTDSRCKARQLELNERTCRCDKPRR

SEQ ID NO: 960 - protein, 371 aa, homo sapiens
MTDRQTDTAPSPSYHLLPGRRRTVDAAASRGQGPEPAPGGGVEGVGARGVALKLFVQLLGCSRFGGAVVRAGEAEPSGAARSASSGREEPQPEEGEEEEEKEEERGPQWRLGARKPGSWTGEAAVCADSAPAARAPQALARASGRGGRVARRGAEESGPPHSPSRRGSASRAGPGRASETMNFLLSWVHWSLALLLYLHHAKWSQAAPMAEGGGQNHHEVVKFMDVYQRSYCHPIETLVDIFQEYPDEIEYIFKPSCVPLMRCGGCCNDEGLECVPTEESNITMQIMRIKPHQGQHIGEMSFLQHNKCECRPKKDRARQENPCGPCSERRKHLFVQDPQTCKCSCKNTDSRCKARQLELNERTCRCDKPRR

SEQ ID NO: 961 - protein, 371 aa, homo sapiens
MTDRQTDTAPSPSYHLLPGRRRTVDAAASRGQGPEPAPGGGVEGVGARGVALKLFVQLLGCSRFGGAVVRAGEAEPSGAARSASSGREEPQPEEGEEEEEKEEERGPQWRLGARKPGSWTGEAAVCADSAPAARAPQALARASGRGGRVARRGAEESGPPHSPSRRGSASRAGPGRASETMNFLLSWVHWSLALLLYLHHAKWSQAAPMAEGGGQNHHEVVKFMDVYQRSYCHPIETLVDIFQEYPDEIEYIFKPSCVPLMRCGGCCNDEGLECVPTEESNITMQIMRIKPHQGQHIGEMSFLQHNKCECRPKKDRARQENPCGPCSERRKHLFVQDPQTCKCSCKNTDSRCKARQLELNERTCRSLTRKD

SEQ ID NO: 962 - protein, 354 aa, homo sapiens
MTDRQTDTAPSPSYHLLPGRRRTVDAAASRGQGPEPAPGGGVEGVGARGVALKLFVQLLGCSRFGGAVVRAGEAEPSGAARSASSGREEPQPEEGEEEEEKEEERGPQWRLGARKPGSWTGEAAVCADSAPAARAPQALARASGRGGRVARRGAEESGPPHSPSRRGSASRAGPGRASETMNFLLSWVHWSLALLLYLHHAKWSQAAPMAEGGGQNHHEVVKFMDVYQRSYCHPIETLVDIFQEYPDEIEYIFKPSCVPLMRCGGCCNDEGLECVPTEESNITMQIMRIKPHQGQHIGEMSFLQHNKCECRPKKDRARQENPCGPCSERRKHLFVQDPQTCKCSCKNTDSRCKM

SEQ ID NO: 963 - protein, 327 aa, homo sapiens
MTDRQTDTAPSPSYHLLPGRRRTVDAAASRGQGPEPAPGGGVEGVGARGVALKLFVQLLGCSRFGGAVVRAGEAEPSGAARSASSGREEPQPEEGEEEEEKEEERGPQWRLGARKPGSWTGEAAVCADSAPAARAPQALARASGRGGRVARRGAEESGPPHSPSRRGSASRAGPGRASETMNFLLSWVHWSLALLLYLHHAKWSQAAPMAEGGGQNHHEVVKFMDVYQRSYCHPIETLVDIFQEYPDEIEYIFKPSCVPLMRCGGCCNDEGLECVPTEESNITMQIMRIKPHQGQHIGEMSFLQHNKCECRPKKDRARQEKCDKPRR

SEQ ID NO: 964 - protein, 207 aa, homo sapiens
MSPLLRRLLLAALLQLAPAQAPVSQPDAPGHQRKVVSWIDVYTRATCQPREVVVPLTVELMGTVAKQLVPSCVTVQRCGGCCPDDGLECVPTGQHQVRMQILMIRYPSSQLGEMSLEEHSQCECRPKKKDSAVKPDRAATPHHRPQPRSVPGWDSAPGAPSPADITHPTPAPGPSAHAAPSTTSALTPGPAAAAADAAASSVAKGGA

SEQ ID NO: 965 - protein, 419 aa, homo sapiens
MHLLGFFSVACSLLAAALLPGPREAPAAAAAFESGLDLSDAEPDAGEATAYASKDLEEQLRSVSSVDELMTVLYPEYWKMYKCQLRKGGWQHNREQANLNSRTEETIKFAAAHYNTEILKSIDNEWRKTQCMPREVCIDVGKEFGVATNTFFKPPCVSVYRCGGCCNSEGLQCMNTSTSYLSKTLFEITVPLSQGPKPVTISFANHTSCRCMSKLDVYRQVHSIIRRSLPATLPQCQAANKTCPTNYMWNNHICRCLAQEDFMFSSDAGDDSTDGFHDICGPNKELDEETCQCVCRAGLRPASCGPHKELDRNSCQCVCKNKLFPSQCGANREFDENTCQCVCKRTCPRNQPLNPGKCACECTESPQKCLLKGKKFHHQTCSCYRRPCTNRQKACEPGFSYSEEVCRCVPSYWKRPQMS

SEQ ID NO: 966 - protein, 5 aa, Artificial Sequence
  A-71623
  MISC_FEATURE (1)..(1): Xaa = Boc-Trp
  MISC_FEATURE (3)..(3): Xaa = Lys(Tac)
  MOD_RES (5)..(5): AMIDATION
  MISC_FEATURE (5)..(5): Xaa = N-methyl-Phe
XWXDX

SEQ ID NO: 967 - protein, 5 aa, Artificial Sequence
  Enterostatin
APGPR

SEQ ID NO: 968 - protein, 25 aa, Artificial Sequence
  Annexin/lipocortin 1-mimetic peptide Ac2-26
  MOD_RES (1)..(1): ACETYLATION
AMVSEFLKQAWFIENEEQEYVQTVK

SEQ ID NO: 969 - protein, 20 aa, Artificial Sequence
  Peptide F9
RYVVLPRPVCFEKGMNYTVR

SEQ ID NO: 970 - protein, 20 aa, Artificial Sequence
  R18
PHCVPRDLSWLDLEANMCLP

SEQ ID NO: 971 - protein, 43 aa, Artificial Sequence
  Thymosin _4
  MOD_RES (1)..(1): ACETYLATION
SDKPDMAEIEKFDKSKLKKTETQEKNPLPSKETIEQEKQAGES

SEQ ID NO: 972 - protein, 21 aa, Artificial Sequence
  Anti-GluR4 blocking peptide
KHTGTAIRQSSGLAVIASDLP

SEQ ID NO: 973 - protein, 12 aa, Artificial Sequence
  Anti-phospho-GluR1 (Ser831) phosphorylated blocking peptide
  MISC_FEATURE (6)..(6): Xaa = phosphorolyated Serine
LIPQQXINEAIK

SEQ ID NO: 974 - protein, 42 aa, Artificial Sequence
  PHV (1-42)
HADGVFTSDFSKLLGQLSAKKYLESLMGKRVSSNISEDPVPV

SEQ ID NO: 975 - protein, 29 aa, Artificial Sequence
  PRP
DVAHGILNQAYRKVLDQLSAGKHLQSLVA

SEQ ID NO: 976 - protein, 326 aa, homo sapiens
MPPSISAFQAAYIGIEVLIALVSVPGNVLVIWAVKVNQALRDATFCFIVSLAVADVAVGALVIPLAILINIGPQTYFHTCLMVACPVLILTQSSILALLAIAVDRYLRVKIPLRYKMVVTPRRAAVAIAGCWILSFVVGLTPMFGWNNLSAVERAWAANGSMGEPVIKCEFEKVISMEYMVYFNFFVWVLPPLLLMVLIYLEVFYLIRKQLNKKVSASSGDPQKYYGKELKIAKSLALILFLFALSWLPLHILNCITLFCPSCHKPSILTYIAIFLTHGNSAMNPIVYAFRIQKFRVTFLKIWNDHFRCQPAPPIDEDLPEERPDD

SEQ ID NO: 977 - protein, 332 aa, homo sapiens
MLLETQDALYVALELVIAALSVAGNVLVCAAVGTANTLQTPTNYFLVSLAAADVAVGLFAIPFAITISLGFCTDFYGCLFLACFVLVLTQSSIFSLLAVAVDRYLAICVPLRYKSLVTGTRARGVIAVLWVLAFGIGLTPFLGWNSKDSATNNCTEPWDGTTNESCCLVKCLFENVVPMSYMVYFNFFGCVLPPLLIMLVIYIKIFLVACRQLQRTELMDHSRTTLQREIHAAKSLAMIVGIFALCWLPVHAVNCVTLFQPAQGKNKPKWAMNMAILLSHANSVVNPIVYAYRNRDFRYTFHKIISRYLLCQADVKSGNGQAGVQPALGVGL

SEQ ID NO: 978 - protein, 318 aa, homo sapiens
MPNNSTALSLANVTYITMEIFIGLCAIVGNVLVICVVKLNPSLQTTTFYFIVSLALADIAVGVLVMPLAIVVSLGITIHFYSCLFMTCLLLIFTHASIMSLLAIAVDRYLRVKLTVRYKRVTTHRRIWLALGLCWLVSFLVGLTPMFGWNMKLTSEYHRNVTFLSCQFVSVMRMDYMVYFSFLTWIFIPLVVMCAIYLDIFYIIRNKLSLNLSNSKETGAFYGREFKTAKSLFLVLFLFALSWLPLSIINCIIYFNGEVPQLVLYMGILLSHANSMMNPIVYAYKIKKFKETYLLILKACVVCHPSDSLDTSIEKNSE

SEQ ID NO: 979 - protein, 572 aa, homo sapiens
MTFRDLLSVSFEGPRPDSSAGGSSAGGGGGSAGGAAPSEGPAVGGVPGGAGGGGGVVGAGSGEDNRSSAGEPGSAGAGGDVNGTAAVGGLVVSAQGVGVGVFLAAFILMAVAGNLLVILSVACNRHLQTVTNYFIVNLAVADLLLSATVLPFSATMEVLGFWAFGRAFCDVWAAVDVLCCTASILSLCTISVDRYVGVRHSLKYPAIMTERKAAAILALLWVVALVVSVGPLLGWKEPVPPDERFCGITEEAGYAVFSSVCSFYLPMAVIVVMYCRVYVVARSTTRSLEAGVKRERGKASEVVLRIHCRGAATGADGAHGMRSAKGHTFRSSLSVRLLKFSREKKAAKTLAIVVGVFVLCWFPFFFVLPLGSLFPQLKPSEGVFKVIFWLGYFNSCVNPLIYPCSSREFKRAFLRLLRCQCRRRRRRRPLWRVYGHHWRASTSGLRQDCAPSSGDAPPGAPLALTALPDPDPEPPGTPEMQAPVASRRKPPSAFREWRLLGPFRRPTTQLRAKVSSLSHKIRAGGAQRAEAACAQRSEVEAVSLGVPHEVAEGATCQAYELADYSNLRETDI

SEQ ID NO: 980 - protein, 520 aa, homo sapiens
MNPDLDTGHNTSAPAHWGELKNANFTGPNQTSSNSTLPQLDITRAISVGLVLGAFILFAIVGNILVILSVACNRHLRTPTNYFIVNLAMADLLLSFTVLPFSAALEVLGYWVLGRIFCDIWAAVDVLCCTASILSLCAISIDRYIGVRYSLQYPTLVTRRKAILALLSVWVLSTVISIGPLLGWKEPAPNDDKECGVTEEPFYALFSSLGSFYIPLAVILVMYCRVYIVAKRTTKNLEAGVMKEMSNSKELTLRIHSKNFHEDTLSSTKAKGHNPRSSIAVKLFKFSREKKAAKTLGIVVGMFILCWLPFFIALPLGSLFSTLKPPDAVFKVVFWLGYFNSCLNPIIYPCSSKEFKRAFVRILGCQCRGRGRRRRRRRRRLGGCAYTYRPWTRGGSLERSQSRKDSLDDSGSCLSGSQRTLPSASPSPGYLGRGAPPPVELCAFPEWKAPGALLSLPAPEPPGRRGRHDSGPLFTFKLLTEPESPGTDGGASNGGCEAAADVANGQPGFKSNMPLAPGQF

SEQ ID NO: 981 - protein, 413 aa, homo sapiens
MGQPGNGSAFLLAPNRSHAPDHDVTQQRDEVWVVGMGIVMSLIVLAIVFGNVLVITAIAKFERLQTVTNYFITSLACADLVMGLAVVPFGAAHILMKMWTFGNFWCEFWTSIDVLCVTASIETLCVIAVDRYFAITSPFKYQSLLTKNKARVIILMVWIVSGLTSFLPIQMHWYRATHQEAINCYANETCCDFFTNQAYAIASSIVSFYVPLVIMVFVYSRVFQEAKRQLQKIDKSEGRFHVQNLSQVEQDGRTGHGLRRSSKFCLKEHKALKTLGIIMGTFTLCWLPFFIVNIVHVIQDNLIRKEVYILLNWIGYVNSGFNPLIYCRSPDFRIAFQELLCLRRSSLKAYGNGYSSNGNTGEQSGYHVEQEKENKLLCEDLPGTEDFVGHQGTVPSDNIDSQGRNCSTNDSLL

SEQ ID NO: 982 - protein, 359 aa, homo sapiens [sequence omitted]

SEQ ID NO: 983 - protein, 418 aa, homo sapiens
MRLSAGPDAGPSGNSSPWWPLATGAGNTSREAEALGEGNGPPRDVRNEELAKLEIAVLAVTFAVAVLGNSSVLLALHRTPRKTSRMHLFIRHLSLADLAVAFFQVLPQMCWDITYRFRGPDWLCRVVKHLQVFGMFASAYMLVVMTADRYIAVCHPLKTLQQPARRSRLMIAAAWVLSFVLSTPQYFVFSMIEVNNVTKARDCWATFIQPWGSRAYVTWMTGGIFVAPVVILGTCYGFICYNIWCNVRGKTASRQSKGAEQAGVAFQKGFLLAPCVSSVKSISRAKIRTVKMTFVIVTAYIVCWAPFFIIQMWSVWDPMSVWTESENPTITITALLGSLNSCCNPWIYMFFSGHLLQDCVQSFPCCQNMKEKFNKEDTDSMSRRQTFYSNNRSPTNSTGMWKDSPKSSKSIKFIPVST

SEQ ID NO: 984 - protein, 424 aa, homo sapiens
MDSGPLWDANPTPRGTLSAPNATTPWLGRDEELAKVEIGVLATVLVLATGGNLAVLLTLGQLGRKRSRMHLFVLHLALTDLAVALFQVLPQLLWDITYRFQGPDLLCRAVKYLQVLSMFASTYMLLAMTLDRYLAVCHPLRSLQQPGQSTYLLIAAPWLLAAIFSLPQVFIFSLREVIQGSGVLDCWADFGFPWGPRAYLTWTTLAIFVLPVTMLTACYSLICHEICKNLKVKTQAWRVGGGGWRTWDRPSPSTLAATTRGLPSRVSSINTISRAKIRTVKMTFVIVLAYIACWAPFFSVQMWSVWDKNAPDEDSTNVAFTISMLLGNLNSCCNPWIYMGFNSHLLPRPLRHLACCGGPQPRMRRRLSDGSLSSRHTTLLTRSSCPATLSLSLSLTLSGRPRPEESPRDLELADGEGTAETIIF

SEQ ID NO: 985 - protein, 1522 aa, homo sapiens
MKAVRNLLIYIFSTYLLVMFGFNAAQDFWCSTLVKGVIYGSYSVSEMFPKNFTNCTWTLENPDPTKYSIYLKFSKKDLSCSNFSLLAYQFDHFSHEKIKDLLRKNHSIMQLCNSKNAFVFLQYDKNFIQIRRVFPTNFPGLQKKGEEDQKSFFEFLVLNKVSPSQFGCHVLCTWLESCLKSENGRTESCGIMYTKCTCPQHLGEWGIDDQSLILLNNVVLPLNEQTEGCLTQELQTTQVCNLTREAKRPPKEEFGMMGDHTIKSQRPRSVHEKRVPQEQADAAKFMAQTGESGVEEWSQWSTCSVTCGQGSQVRTRTCVSPYGTHCSGPLRESRVCNNTALCPVHGVWEEWSPWSLCSFTCGRGQRTRTRSCTPPQYGGRPCEGPETHHKPCNIALCPVDGQWQEWSSWSQCSVTCSNGTQQRSRQCTAAAHGGSECRGPWAESRECYNPECTANGQWNQWGHWSGCSKSCDGGWERRIRTCQGAVITGQQCEGTGEEVRRCSEQRCPAPYEICPEDYLMSMVWKRTPAGDLAFNQCPLNATGTTSRRCSLSLHGVAFWEQPSFARCISNEYRHLQHSIKEHLAKGQRMLAGDGMSQVTKTLLDLTQRKNFYAGDLLMSVEILRNVTDTFKRASYIPASDGVQNFFQIVSNLLDEENKEKWEDAQQIYPGSIELMQVIEDFIHIVGMGMMDFQNSYLMTGNVVASIQKLPAASVLTDINFPMKGRKGMVDWARNSEDRVVIPKSIFTPVSSKELDESSVFVLGAVLYKNLDLILPTLRNYTVINSKIIVVTIRPEPKTTDSFLEIELAHLANGTLNPYCVLWDDSKTNESLGTWSTQGCKTVLTDASHTKCLCDRLSTFAILAQQPREIIMESSGTPSVTLIVGSGLSCLALITLAVVYAALWRYIRSERSIILINFCLSIISSNILILVGQTQTHNKSICTTTTAFLHFFFLASFCWVLTEAWQSYMAVTGKIRTRLIRKRFLCLGWGLPALVVATSVGFTRTKGYGTDHYCWLSLEGGLLYAFVGPAAAVVLVNMVIGILVFNKLVSRDGILDKKLKHRAGQMSEPHSGLTLKCAKCGVVSTTALSATTASNAMASLWSSCVVLPLLALTWMSAVLAMTDKRSILFQILFAVFDSLQGFVIVMVHCILRREVQDAFRCRLRNCQDPINADSSSSFPNGHAQIMTDFEKDVDIACRSVLHKDIGPCRAATITGTLSRISLNDDEEEKGTNPEGLSYSTLPGNVISKVIIQQPTGLHMPMSMNELSNPCLKKENSELRRTVYLCTDDNLRGADMDIVHPQERMMESDYIVMPRSSVNNQPSMKEESKMNIGMETLPHERLLHYKVNPEFNMNPPVMDQFNMNLEQHLAPQEHMQNLPFEPRTAVKNFMASELDDNAGLSRSETGSTISMSSLERRKSRYSDLDFEKVMHTRKRHMELFQELNQKFQTLDRFRDIPNTSSMENPAPNKNPWDTFKNPSEYPHYTTINVLDTEAKDALELRPAEWEKCLNLPLDVQEGDFQTEV

SEQ ID NO: 986 - protein, 372 aa, homo sapiens
MNYPLTLEMDLENLEDLFWELDRLDNYNDTSLVENHLCPATEGPLMASFKAVFVPVAYSLIFLLGVIGNVLVLVILERHRQTRSSTETFLFHLAVADLLLVFILPFAVAEGSVGWVLGTFLCKTVIALHKVNFYCSSLLLACIAVDRYLAIVHAVHAYRHRRLLSIHITCGTIWLVGFLLALPEILFAKVSQGHHNNSLPRCTFSQENQAETHAWFTSRFLYHVAGFLLPMLVMGWCYVGVVHRLRQAQRRPQRQKAVRVAILVTSIFFLCWSPYHIVIFLDTLARLKAVDNTCKLNGSLPVAITMCEFLGLAHCCLNPMLYTFAGVKFRSDLSRLLTKLGCTGPASLCQLFPSWRRSSLSESENATSLTTF

SEQ ID NO: 987 - protein, 399 aa, homo sapiens
MAQRQPHSPNQTLISITNDTESSSSVVSNDNTNKGWSGDNSPGIEALCAIYITYAVIISVGILGNAILIKVFFKTKSMQTVPNIFITSLAFGDLLLLLTCVPVDATHYLAEGWLFGRIGCKVLSFIRLTSVGVSVFTLTILSADRYKAVVKPLERQPSNAILKTCVKAGCVWIVSMIFALPEAIFSNVYTFRDPNKNMTFESCTSYPVSKKLLQEIHSLLCFLVFYIIPLSIISVYYSLIARTLYKSTLNIPTEEQSHARKQIESRKRIARTVLVLVALFALCWLPNHLLYLYHSFTSQTYVDPSAMHFIFTIFSRVLAFSNSCVNPFALYWLSKSFQKHFKAQLFCCKAERPEPPVADTSLTTLAVMGTVPGTGSIQMSEISVTSFTGCSVKQAEDRF

SEQ ID NO: 988 - protein, 350 aa, homo sapiens
MNSFNYTTPDYGHYDDKDTLDLNTPVDKTSNTLRVPDILALVIFAVVFLVGVLGNALVVWVTAFEAKRTINAIWFLNLAVADFLSCLALPILFTSIVQHHHWPFGGAACSILPSLILLNMYASILLLATISADRFLLVFKPIWCQNFRGAGLAWIACAVAWGLALLLTIPSFLYRVVREEYFPPKVLCGVDYSHDKRRERAVAIVRLVLGFLWPLLTLTICYTFILLRTWSRRATRSTKTLKVVVAVVASFFIFWLPYQVTGIMMSFLEPSSPTFLLLNKLDSLCVSFAYINCCINPIIYVVAGQGFQGRLRKSLPSLLRNVLTEESVVRESKSFTRSTVDTMAQKTQAV

SEQ ID NO: 989 - protein, 474 aa, homo sapiens
MRFTFTSRCLALFLLLNHPTPILPAFSNQTYPTIEPKPFLYVVGRKKMMDAQYKCYDRMQQLPAYQGEGPYCNRTWDGWLCWDDTPAGVLSYQFCPDYFPDFDPSEKVTKYCDEKGVWFKHPENNRTWSNYTMCNAFTPEKLKNAYVLYYLAIVGHSLSIFTLVISLGIFVFFRSLGCQRVTLHKNMFLTYILNSMIIIIHLVEVVPNGELVRRDPVSCKILHFFHQYMMACNYFWMLCEGIYLHTLIVVAVFTEKQRLRWYYLLGWGFPLVPTTIHAITRAVYFNDNCWLSVETHLLYIIHGPVMAALVVNFFFLLNIVRVLVTKMRETHEAESHMYLKAVKATMILVPLLGIQFVVFPWRPSNKMLGKIYDYVMHSLIHFQGFFVATIYCFCNNEVQTTVKRQWAQFKIQWNQRWGRRPSNRSARAAAAAAEAGDIPIYICHQELRNEPANNQGEESAEIIPLNIIEQESSA

SEQ ID NO: 990 - protein, 428 aa, homo sapiens
MDVVDSLLVNGSNITPPCELGLENETLFCLDQPRPSKEWQPAVQILLYSLIFLLSVLGNTLVITVLIRNKRMRTVTNIFLLSLAVSDLMLCLFCMPFNLIPNLLKDFIFGSAVCKTTTYFMGTSVSVSTFNLVAISLERYGAICKPLQSRVWQTKSHALKVIAATWCLSFTIMTPYPIYSNLVPFTKNNNQTANMCRFLLPNDVMQQSWHTFLLLILFLIPGIVMMVAYGLISLELYQGIKFEASQKKSAKERKPSTTSSGKYEDSDGCYLQKTRPPRKLELRQLSTGSSSRANRIRSNSSAANLMAKKRVIRMLIVIVVLFFLCWMPIFSANAWRAYDTASAERRLSGTPISFILLLSYTSSCVNPIIYCFMNKRFRLGFMATFPCCPNPGPPGARGEVGEEEEGGTTGASLSRFSYSHMSASVPPQ

SEQ ID NO: 991 - protein, 355 aa, homo sapiens
METPNTTEDYDTTTEFDYGDATPCQKVNERAFGAQLLPPLYSLVFVIGLVGNILVVLVLVQYKRLKNMTSIYLLNLAISDLLFLFTLPFWIDYKLKDDWVFGDAMCKILSGFYYTGLYSEIFFIILLTIDRYLAIVHAVFALRARTVTFGVITSIIIWALAILASMPGLYFSKTQWEFTHHTCSLHFPHESLREWKLFQALKLNLFGLVLPLLVMIICYTGIIKILLRRPNEKKSKAVRLIFVIMIIFFLFWTPYNLTILISVFQDFLFTHECEQSRHLDLAVQVTEVIAYTHCCVNPVIYAFVGERFRKYLRQLFHRRVAVHLVKWLPFLSVDRLERVSSTSPSTGEHELSAGF

SEQ ID NO: 992 - protein, 355 aa, homo sapiens
MTTSLDTVETFGTTSYYDDVGLLCEKADTRALMAQFVPPLYSLVFTVGLLGNVVVVMILIKYRRLRIMTNIYLLNLAISDLLFLVTLPFWIHYVRGHNWVFGHGMCKLLSGFYHTGLYSEIFFIILLTIDRYLAIVHAVFALRARTVTFGVITSIVTWGLAVLAALPEFIFYETEELFEETLCSALYPEDTVYSWRHFHTLRMTIFCLVLPLLVMAICYTGIIKTLLRCPSKKKYKAIRLIFVIMAVFFIFWTPYNVAILLSSYQSILFGNDCERSKHLDLVMLVTEVIAYSHCCMNPVIYAFVGERFRKYLRHFFHRHLLMHLGRYIPFLPSEKLERTSSVSPSTAEPELSIVF

SEQ ID NO: 993 - protein, 352 aa, homo sapiens [sequence omitted]

SEQ ID NO: 994 - protein, 378 aa, homo sapiens
MDLGKPMKSVLVVALLVIFQVCLCQDEVTDDYIGDNTTVDYTLFESLCSKKDVRNFKAWFLPIMYSIICFVGLLGNGLVVLTYIYFKRLKTMTDTYLLNLAVADILFLLTLPFWAYSAAKSWVFGVHFCKLIFAIYKMSFFSGMLLLLCISIDRYVAIVQAVSAHRHRARVLLISKLSCVGIWILATVLSIPELLYSDLQRSSSEQAMRCSLITEHVEAFITIQVAQMVIGFLVPLLAMSFCYLVIIRTLLQARNFERNKAIKVIIAVVVVFIVFQLPYNGVVLAQTVANFNITSSTCELSKQLNIAYDVTYSLACVRCCVNPFLYAFIGVKFRNDLFKLFKDLGCLSQEQLRQWSSCRHIRRSSMSVEAETTTTFSP

SEQ ID NO: 995 - protein, 466 aa, homo sapiens
MNNSTNSSNNSLALTSPYKTFEVVFIVLVAGSLSLVTIIGNILVMVSIKVNRHLQTVNNYFLFSLACADLIIGVFSMNLYTLYTVIGYWPLGPVVCDLWLALDYVVSNASVMNLLIISFDRYFCVTKPLTYPVKRTTKMAGMMIAAAWVLSFILWAPAILFWQFIVGVRTVEDGECYIQFFSNAAVTFGTAIAAFYLPVIIMTVLYWHISRASKSRIKKDKKEPVANQDPVSPSLVQGRIVKPNNNNMPSSDDGLEHNKIQNGKAPRDPVTENCVQGEEKESSNDSTSVSAVASNMRDDEITQDENTVSTSLGHSKDENSKQTCIRIGTKTPKSDSCTPTNTTVEVVGSSGQNGDEKQNIVARKIVKMTKQPAKKKPPPSREKKVTRTILAILLAFIITWAPYNVMVLINTFCAPCIPNTVWTIGYWLCYINSTINPACYALCNATFKKTFKHLLMCHYKNIGATR

SEQ ID NO: 996 - protein, 590 aa, homo sapiens
MTLHNNSTTSPLFPNISSSWIHSPSDAGLPPGTVTHFGSYNVSRAAGNFSSPDGTTDDPLGGHTVWQVVFIAFLTGILALVTIIGNILVIVSFKVNKQLKTVNNYFLLSLACADLIIGVISMNLFTTYIIMNRWALGNLACDLWLAIDYVASNASVMNLLVISFDRYFSITRPLTYRAKRTTKRAGVMIGLAWVISFVLWAPAILFWQYFVGKRTVPPGECFIQFLSEPTITFGTAIAAFYMPVTIMTILYWRIYKETEKRTKELAGLQASGTEAETENFVHPTGSSRSCSSYELQQQSMKRSNRRKYGRCHFWFTTKSWKPSSEQMDQDHSSSDSWNNNDAAASLENSASSDEEDIGSETRAIYSIVLKLPGHSTILNSTKLPSSDNLQVPEEELGMVDLERKADKLQAQKSVDDGGSFPKSFSKLPIQLESAVDTAKTSDVNSSVGKSTATLPLSFKEATLAKRFALKTRSQITKRKRMSLVKEKKAAQTLSAILLAFIITWTPYNIMVLVNTFCDSCIPKTFWNLGYWLCYINSTVNPVCYALCNKTFRTTFKMLLLCQCDKKKRRKQQYQQRQSVIFHKRAPEQAL

SEQ ID NO: 997 - protein, 360 aa, homo sapiens
MEECWVTEIANGSKDGLDSNPMKDYMILSGPQKTAVAVLCTLLGLLSALENVAVLYLILSSHQLRRKPSYLFIGSLAGADFLASVVFACSFVNFHVFHGVDSKAVFLLKIGSVTMTFTASVGSLLLTAIDRYLCLRYPPSYKALLTRGRALVTLGIMWVLSALVSYLPLMGWTCCPRPCSELFPLIPNDYLLSWLLFIAFLFSGIIYTYGHVLWKAHQHVASLSGHQDRQVPGMARMRLDVRLAKTLGLVLAVLLICWFPVLALMAHSLATTLSDQVKKAFAFCSMLCLINSMVNPVIYALRSGEIRSSAHHCLAHWKKCVRGLGSEAKEEAPRSSVTETEADGKITPWPDSRDLDLSDC

SEQ ID NO: 998 - protein, 355 aa, homo sapiens
MDQFPESVTENFEYDDLAEACYIGDIVVFGTVFLSIFYSVIFAIGLVGNLLVVFALTNSKKPKSVTDIYLLNLALSDLLFVATLPFWTHYLINEKGLHNAMCKFTTAFFFIGFFGSIFFITVISIDRYLAIVLAANSMNNRTVQHGVTISLGVWAAAILVAAPQFMFTKQKENECLGDYPEVLQEIWPVLRNVETNFLGFLLPLLIMSYCYFRIIQTLFSCKNHKKAKAIKLILLVVIVFFLFWTPYNVMIFLETLKLYDFFPSCDMRKDLRLALSVTETVAFSHCCLNPLIYAFAGEKFRRYLYHLYGKCLAVLCGRSVHVDFSSSESQRSRHGSVLSSNFTYHTSDGDALLLL

SEQ ID NO: 999 - protein, 352 aa, homo sapiens
MEGISIYTSDNYTEEMGSGDYDSMKEPCFREENANFNKIFLPTIYSIIFLTGIVGNGLVILVMGYQKKLRSMTDKYRLHLSVADLLFVITLPFWAVDAVANWYFGNFLCKAVHVIYTVNLYSSVLILAFISLDRYLAIVHATNSQRPRKLLAEKVVYVGVWIPALLLTIPDFIFANVSEADDRYICDRFYPNDLWVVVFQFQHIMVGLILPGIVILSCYCIIISKLSHSKGHQKRKALKTTVILILAFFACWLPYYIGISIDSFILLEIIKQGCEFENTVHKWISITEALAFFHCCLNPILYAFLGAKFKTSAQHALTSVSRGSSLKILSKGKRGGHSSVSTESESSSFHSS

SEQ ID NO: 1000 - protein, 446 aa, homo sapiens
MRTLNTSAMDGTGLVVERDFSVRILTACFLSLLILSTLLGNTLVCAAVIRFRHLRSKVTNFFVISLAVSDLLVAVLVMPWKAVAEIAGFWPFGSFCNIWVAFDIMCSTASILNLCVISVDRYWAISSPFRYERKMTPKAAFILISVAWTLSVLISFIPVQLSWHKAKPTSPSDGNATSLAETIDNCDSSLSRTYAISSSVISFYIPVAIMIVTYTRIYRIAQKQIRRIAALERAAVHAKNCQTTTGNGKPVECSQPESSFKMSFKRETKVLKTLSVIMGVFVCCWLPFFILNCILPFCGSGETQPFCIDSNTFDVFVWFGWANSSLNPIIYAFNADFRKAFSTLLGCYRLCPATNNAIETVSINNNGAAMFSSHHEPRGSISKECNLVYLIPHAVGSSEDLKKEEAAGIARPLEKLSPALSVILDYDTDVSLEKIQPITQNGQHPT

SEQ ID NO: 1001 - protein, 443 aa, homo sapiens
MDPLNLSWYDDDLERQNWSRPFNGSDGKADRPHYNYYATLLTLLIAVIVFGNVLVCMAVSREKALQTTTNYLIVSLAVADLLVATLVMPWVVYLEVVGEWKFSRIHCDIFVTLDVMMCTASILNLCAISIDRYTAVAMPMLYNTRYSSKRRVTVMISIVWVLSFTISCPLLFGLNNADQNECIIANPAFVVYSSIVSFYVPFIVTLLVYIKIYIVLRRRRKRVNTKRSSRAFRAHLRAPLKGNCTHPEDMKLCTVIMKSNGSFPVNRRRVEAARRAQELEMEMLSSTSPPERTRYSPIPPSHHQLTLPDPSHHGLHSTPDSPAKPEKNGHAKDHPKIAKIFEIQTMPNGKTRTSLKTMSRRKLSQQKEKKATQMLAIVLGVFIICWLPFFITHILNIHCDCNIPPVLYSAFTWLGYVNSAVNPIIYTTFNIEFRKAFLKILHC

SEQ ID NO: 1002 - protein, 477 aa, homo sapiens
MLPPGSNGTAYPGQFALYQQLAQGNAVGGSAGAPPLGPSQVVTACLLTLLIIWTLLGNVLVCAAIVRSRHLRANMTNVFIVSLAVSDLFVALLVMPWKAVAEVAGYWPFGAFCDVWVAFDIMCSTASILNLCVISVDRYWAISRPFRYKRKMTQRMALVMVGLAWTLSILISFIPVQLNWHRDQAASWGGLDLPNNLANWTPWEEDFWEPDVNAENCDSSLNRTYAISSSLISFYIPVAIMIVTYTRIYRIAQVQIRRISSLERAAEHAQSCRSSAACAPDTSLRASIKKETKVLKTLSVIMGVFVCCWLPFFILNCMVPFCSGHPEGPPAGFPCVSETTFDVFVWFGWANSSLNPVIYAFNADFQKVFAQLLGCSHFCSRTPVETVNISNELISYNQDIVFHKEIAAAYIHMMPNAVTPGNREVDNDEEEGPFDRMFQIYQTSPDGDPVAESVWELDCEGEISLDKITPFTPNGFH

SEQ ID NO: 1003 - protein, 384 aa, homo sapiens
MNATGTPVAPESCQQLAAGGHSRLIVLHYNHSGRLAGRGGPEDGGLGALRGLSVAASCLVVLENLLVLAAITSHMRSRRWVYYCLVNITLSDLLTGAAYLANVLLSGARTFRLAPAQWFLREGLLFTALAASTFSLLFTAGERFATMVRPVAESGATKTSRVYGFIGLCWLLAALLGMLPLLGWNCLCAFDRCSSLLPLYSKRYILFCLVIFAGVLATIMGLYGAIFRLVQASGQKAPRPAARRKARRLLKTVLMILLAFLVCWGPLFGLLLADVFGSNLWAQEYLRGMDWILALAVLNSAVNPIIYSFRSREVCRAVLSFLCCGCLRLGMRGPGDCLARAVEAHSGASTTDSSLRPRDSFRGSRSLSFRMREPLSSISSVRSI

SEQ ID NO: 1004 - protein, 427 aa, homo sapiens
METLCLRASFWLALVGCVISDNPERYSTNLSNHVDDFTTFRGTELSFLVTTHQPTNLVLPSNGSMHNYCPQQTKITSAFKYINTVISCTIFIVGMVGNATLLRIIYQNKCMRNGPNALIASLALGDLIYVVIDLPINVFKLLAGRWPFDHNDFGVFLCKLFPFLQKSSVGITVLNLCALSVDRYRAVASWSRVQGIGIPLVTAIEIVSIWILSFILAIPEAIGFVMVPFEYRGEQHKTCMLNATSKFMEFYQDVKDWWLFGFYFCMPLVCTAIFYTLMTCEMLNRRNGSLRIALSEHLKQRREVAKTVFCLVVIFALCWFPLHLSRILKKTVYNEMDKNRCELLSFLLLMDYIGINLATMNSCINPIALYFVSKKFKNCFQSCLCCCCYQSKSLMTSVPMNGTSIQWKNHDQNNHNTDRSSHKDSMN

SEQ ID NO: 1005 - protein, 350 aa, homo sapiens
METNSSLPTNISGGTPAVSAGYLFLDIITYLVFAVTFVLGVLGNGLVIWVAGFRMTHTVTTISYLNLAVADFCFTSTLPFFMVRKAMGGHWPFGWFLCKFVFTIVDINLFGSVFLIALIALDRCVCVLHPVWTQNHRTVSLAKKVIIGPWVMALLLTLPVIIRVTTVPGKTGTVACTFNFSPWTNDPKERINVAVAMLTVRGIIRFIIGFSAPMSIVAVSYGLIATKIHKQGLIKSSRPLRVLSFVAAAFFLCWSPYQVVALIATVRIRELLQGMYKEIGIAVDVTSALAFFNSCLNPMLYVFMGQDFRERLIHALPASLERALTEDSTQTSDTATNSTLPSAEVELQAK

SEQ ID NO: 1006 - protein, 351 aa, homo sapiens
METNFSTPLNEYEEVSYESAGYTVLRILPLVVLGVTFVLGVLGNGLVIWVAGFRMTRTVTTICYLNLALADFSFTATLPFLIVSMAMGEKWPFGWFLCKLIHIVVDINLFGSVFLIGFIALDRCICVLHPVWAQNHRTVSLAMKVIVGPWILALVLTLPVFLFLTTVTIPNGDTYCTFNFASWGGTPEERLKVAITMLTARGIIRFVIGFSLPMSIVAICYGLIAAKIHKKGMIKSSRPLRVLTAVVASFFICWFPFQLVALLGTVWLKEMLFYGKYKIIDILVNPTSSLAFFNSCLNPMLYVFVGQDFRERLIHSLPTSLERALSEDSAPTNDTAANSASPPAETELQAM

SEQ ID NO: 1007 - protein, 387 aa, homo sapiens
MNVSGCPGAGNASQAGGGGGWHPEAVIVPLLFALIFLVGTVGNTLVLAVLLRGGQAVSTTNLFILNLGVADLCFILCCVPFQATIYTLDGWVFGSLLCKAVHFLIFLTMHASSFTLAAVSLDRYLAIRYPLHSRELRTPRNALAAIGLIWGLSLLFSGPYLSYYRQSQLANLTVCHPAWSAPRRRAMDICTFVFSYLLPVLVLGLTYARTLRYLWRAVDPVAAGSGARRAKRKVTRMILIVAALFCLCWMPHHALILCVWFGQFPLTRATYALRILSHLVSYANSCVNPIVYALVSKHFRKGFRTICAGLLGRAPGRASGRVCAAARGTHSGSVLERESSDLLHMSEAAGALRPCPGASQPCILEPCPGPSWQGPKAGDSILTVDVA

SEQ ID NO: 1008 - protein, 368 aa, homo sapiens
MADAQNISLDSPGSVGAVAVPVVFALIFLLGTVGNGLVLAVLLQPGPSAWQEPGSTTDLFILNLAVADLCFILCCVPFQATIYTLDAWLFGALVCKAVHLLIYLTMYASSFTLAAVSVDRYLAVRHPLRSRALRTPRNARAAVGLVWLLAALFSAPYLSYYGTVRYGALELCVPAWEDARRRALDVATFAAGYLLPVAVVSLAYGRTLRFLWAAVGPAGAAAAEARRRATGRAGRAMLAVAALYALCWGPHHALILCFWYGRFAFSPATYACRLASHCLAYANSCLNPLVYALASRHFRARFRRLWPCGRRRRHRARRALRRVRPASSGPPGCPGDARPSGRLLAGGGQGPEPREGPVHGGEAARGPE

SEQ ID NO: 1009 - protein, 477 aa, homo sapiens
MPPCQPQRPLLLLLLLLACQPQVPSAQVMDFLFEKWKLYGDQCHHNLSLLPPPTELVCNRTFDKYSCWPDTPANTTANISCPWYLPWHHKVQHRFVFKRCGPDGQWVRGPRGQPWRDASQCQMDGEEIEVQKEVAKMYSSFQVMYTVGYSLSLGALLLALAILGGLSKLHCTRNAIHANLFASFVLKASSVLVIDGLLRTRYSQKIGDDLSVSTWLSDGAVAGCRVAAVFMQYGIVANYCWLLVEGLYLHNLLGLATLPERSFFSLYLGIGWGAPMLFVVPWAVVKCLFENVQCWTSNDNMGFWWILRFPVFLAILINFFIFVRIVQLLVAKLRARQMHHTDYKFRLAKSTLTLIPLLGVHEVVFAFVTDEHAQGTLRSAKLFFDLFLSSFQGLLVAVLYCFLNKEVQSELRRRWHRWRLGKVLWEERNTSNHRASSSPGHGPPSKELQFGRGGGSQDSSAETPLAGGLPRLAESPF

SEQ ID NO: 1010 - protein, 466 aa, homo sapiens
MTTSPILQLLLRLSLCGLLLQRAETGSKGQTAGELYQRWERYRRECQETLAAAEPPSGLACNGSFDMYVCWDYAAPNATARASCPWYLPWHHHVAAGFVLRQCGSDGQWGLWRDHTQCENPEKNEAFLDQRLILERLQVMYTVGYSLSLATLLLALLILSLFRRLHCTRNYIHINLFTSFMLRAAAILSRDRLLPRPGPYLGDQALALWNQALAACRTAQIVTQYCVGANYTWLLVEGVYLHSLLVLVGGSEEGHFRYYLLLGWGAPALFVIPWVIVRYLYENTQCWERNEVKAIWWIIRTPILMTILINFLIFIRILGILLSKLRTRQMRCRDYRLRLARSTLTLVPLLGVHEVVFAPVTEEQARGALRFAKLGFEIFLSSFQGFLVSVLYCFINKEVQSEIRRGWHHCRLRRSLGEEQRQLPERAFRALPSGSGPGEVPTSRGLSSGTLPGPGNEASRELESYC

SEQ ID NO: 1011 - protein, 328 aa, homo sapiens
MANSASPEQNQNHCSAINNSIPLMQGNLPTLTLSGKIRVTVTFFLFLLSATFNASFLLKLQKWTQKKEKGKKLSRMKLLLKHLTLANLLETLIVMPLDGMWNITVQWYAGELLCKVLSYLKLFSMYAPAFMMVVISLDRSLAITRPLALKSNSKVGQSMVGLAWILSSVFAGPQLYIFRMIHLADSSGQTKVFSQCVTHCSFSQWWHQAFYNFFTFSCLFIIPLFIMLICNAKIIFTLTRVLHQDPHELQLNQSKNNIPRARLKTLKMTVAFATSFTVCWTPYYVLGIWYWFDPEMLNRLSDPVNHFFFLFAFLNPCFDPLIYGYFSL

SEQ ID NO: 1012 - protein, 375 aa, homo sapiens
MDVTSQARGVGLEMYPGTAQPAAPNTTSPELNLSHPLLGTALANGTGELSEHQQYVIGLFLSCLYTIFLFPIGFVGNILILVVNISFREKMTIPDLYFINLAVADLILVADSLIEVFNLHERYYDIAVLCTFMSLFLQVNMYSSVFFLTWMSFDRYIALARAMRCSLFRTKHHARLSCGLIWMASVSATLVPFTAVHLQHTDEACFCFADVREVQWLEVTLGFIVPFAIIGLCYSLIVRVLVRAHRHRGLRPRRQKALRMILAVVLVFFVCWLPENVFISVHLLQRTQPGAAPCKQSFRHAHPLTGHIVNLAAFSNSCLNPLIYSFLGETFRDKLRLYIEQKTNLPALNRFCHAALKAVIPDSTEQSDVRFSSAV

SEQ ID NO: 1013 - protein, 356 aa, homo sapiens
MNGVSEGTRGCSDRQPGVLTRDRSCSRKMNSSGCLSEEVGSLRPLTVVILSASIVVGVLGNGLVLWMTVFRMARTVSTVCFFHLALADFMLSLSLPIAMYYIVSRQWLLGEWACKLYITFVFLSYFASNCLLVFISVDRCISVLYPVWALNHRTVQRASWLAFGVWLLAAALCSAHLKFRTTRKWNGCTHCYLAFNSDNETAQIWIEGVVEGHIIGTIGHFLLGFLGPLAIIGTCAHLIRAKLLREGWVHANRPKRLLLVLVSAFFIFWSPFNVVLLVHLWRRVMLKEIYHPRMLLILQASFALGCVNSSLNPFLYVFVGRDFQEKFFQSLTSALARAFGEEEFLSSCPRGNAPRE

SEQ ID NO: 1014 - protein, 412 aa, homo sapiens
MGSPWNGSDGPEGAREPPWPALPPCDERRCSPFPLGALVPVTAVCLCLFVVGVSGNVVTVMLIGRYRDMRTTTNLYLGSMAVSDLLILLGLPFDLYRLWRSRPWVFGPLLCRLSLYVGEGCTYATLLHMTALSVERYLAICRPLRARVLVTRRRVRALIAVLWAVALLSAGPFLFLVGVEQDPGISVVPGLNGTARIASSPLASSPPLWLSRAPPPSPPSGPETAEAAALFSRECRPSPAQLGALRVMLWVTTAYFFLPFLCLSILYGLIGRELWSSRRPLRGPAASGRERGHRQTVRVLLVVVLAFIICWLPFHVGRIIYINTEDSRMMYFSQYFNIVALQLFYLSASINPILYNLISKKYRAAAFKLLLARKSRPRGFHRSRDTAGEVAGDTGGDTVGYTETSANVKTMG

SEQ ID NO: 1015 - protein, 453 aa, homo sapiens
MASPSLPGSDCSQIIDHSHVPEFEVATWIKITLILVYLIIFVMGLLGNSATIRVTQVLQKKGYLQKEVTDHMVSLACSDILVFLIGMPMEFYSIIWNPLTTSSYTLSCKLHTFLFEACSYATLLHVLTLSFERYIAICHPFRYKAVSGPCQVKLLIGFVWVTSALVALPLLFAMGTEYPLVNVPSHRGLTCNRSSTRHHEQPETSNMSICTNLSSRWTVFQSSIFGAFVVYLVVLLSVAFMCWNMMQVLMKSQKGSLAGGTRPPQLRKSESEESRTARRQTIIFLRLIVVTLAVCWMPNQIRRIMAAAKPKHDWTRSYFRAYMILLPFSETFFYLSSVINPLLYTVSSQQFRRVFVQVLCCRLSLQHANHEKRLRVHAHSTTDSARFVQRPLLFASRRQSSARRTEKIFLSTFQSEAEPQSKSQSLSLESLEPNSGAKPANSAAENGFQEHEV

SEQ ID NO: 1016 - protein, 368 aa, homo sapiens
MVLEVSDHQVLNDAEVAALLENFSSSYDYGENESDSCCTSPPCPQDFSLNFDRAFLPALYSLLFLLGLLGNGAVAAVLLSRRTALSSTDTFLLHLAVADTLLVLTLPLWAVDAAVQWVFGSGLCKVAGALFNINFYAGALLLACISFDRYLNIVHATQLYRRGPPARVTLTCLAVWGLCLLFALPDFIFLSAHHDERLNATHCQYNFPQVGRTALRVLQLVAGFLLPLLVMAYCYAHILAVLLVSRGQRRLRAMRLVVVVVVAFALCWTPYHLVVLVDILMDLGALARNCGRESRVDVAKSVTSGLGYMHCCLNPLLYAFVGVKFRERMWMLLLRLGCPNQRGLQRQPSSSRRDSSWSETSEASYSGL

SEQ ID NO: 1017 - protein, 912 aa, homo sapiens
MPGKRGLGWWWARLPLCLLLSLYGPWMPSSLGKPKGHPHMNSIRIDGDITLGGLFPVHGRGSEGKPCGELKKEKGIHRLEAMLFALDRINNDPDLLPNITLGARILDTCSRDTHALEQSLTFVQALIEKDGTEVRCGSGGPPIITKPERVVGVIGASGSSVSIMVANILRLFKIPQISYASTAPDLSDNSRYDFFSRVVPSDTYQAQAMVDIVRALKWNYVSTVASEGSYGESGVEAFIQKSREDGGVCIAQSVKIPREPKAGEFDKIIRRLLETSNARAVIIFANEDDIRRVLEAARRANQTGHFFWMGSDSWGSKIAPVLHLEEVAEGAVTILPKRMSVRGFDRYFSSRTLDNNRRNIWFAEFWEDNFHCKLSRHALKKGSHVKKCTNRERIGQDSAYEQEGKVQFVIDAVYAMGHALHAMHRDLCPGRVGLCPRMDPVDGTQLLKYIRNVNFSGIAGNPVTFNENGDAPGRYDIYQYQLRNDSAEYKVIGSWTDHLHLRIERMHWPGSGQQLPRSICSLPCQPGERKKTVKGMPCCWHCEPCTGYQYQVDRYTCKTCPYDMRPTENRTGCRPIPIIKLEWGSPWAVLPLFLAVVGIAATLFVVITFVRYNDTPIVKASGRELSYVLLAGIFLCYATTFLMIAEPDLGTCSLRRIFLGLGMSISYAALLTKTNRIYRIFEQGKRSVSAPRFISPASQLAITFSLISLQLLGICVWFVVDPSHSVVDFQDQRTLDPRFARGVLKCDISDLSLICLLGYSMLLMVTCTVYAIKTRGVPETFNEAKPIGFTMYTTCIVWLAFIPIFFGTSQSADKLYIQTTTLTVSVSLSASVSLGMLYMPKVYIILFHPEQNVPKRKRSLKAVVTAATMSNKFTQKGNFRPNGEAKSELCENLEAPALATKQTYVTYTNHAI

SEQ ID NO: 1018 - protein, 1180 aa, homo sapiens
MVLLLILSVLLLKEDVRGSAQSSERRVVAHMPGDIIIGALFSVHHQPTVDKVHERKCGAVREQYGIQRVEAMLHTLERINSDPTLLPNITLGCEIRDSCWHSAVALEQSIEFIRDSLISSEEEEGLVRCVDGSSSSFRSKKPIVGVIGPGSSSVAIQVQNLLQLFNIPQIAYSATSMDLSDKTLFKYFMRVVPSDAQQARAMVDIVKRYNWTYVSAVHTEGNYGESGMEAFKDMSAKEGICIAHSYKIYSNAGEQSFDKLLKKLTSHLPKARVVACFCEGMTVRGLLMAMRRLGLAGEFLLLGSDGWADRYDVTDGYQREAVGGITIKLQSPDVKWFDDYYLKLRPETNHRNPWFQEFWQHRFQCRLEGFPQENSKYNKTCNSSLTLKTHHVQDSKMGFVINAIYSMAYGLHNMQMSLCPGYAGLCDAMKPIDGRKLLESLMKTNFTGVSGDTILFDENGDSPGRYEIMNFKEMGKDYFDYINVGSWDNGELKMDDDEVWSKKSNIIRSVCSEPCEKGQIKVIRKGEVSCCWTCTPCKENEYVFDEYTCKACQLGSWPTDDLTGCDLIPVQYLRWGDPEPIAAVVFACLGLLATLFVTVVFIIYRDTPVVKSSSRELCYIILAGICLGYLCTFCLIAKPKQIYCYLQRIGIGLSPAMSYSALVTKTNRIARILAGSKKKICTKKPRFMSACAQLVIAFILICIQLGIIVALFIMEPPDIMHDYPSIREVYLICNTTNLGVVTPLGYNGLLILSCTFYAFKTRNVPANFNEAKYIAFTMYTTCIIWLAFVPIYFGSNYKIITMCFSVSLSATVALGCMFVPKVYIILAKPERNVRSAFTTSTVVRMHVGDGKSSSAASRSSSLVNLWKRRGSSGETLSSNGKSVTWAQNEKSSRGQHLWQRLSIHINKKENPNQTAVIKPFPKSTESRGLGAGAGAGGSAGGVGATGGAGCAGAGPGGPESPDAGPKALYDVAEAEEHFPAPARPRSPSPISTLSHRAGSASRTDDDVPSLHSEPVARSSSSQGSLMEQISSVVTRFTANISELNSMMLSTAAPSPGVGAPLCSSYLIPKEIQLPTTMTTFAEIQPLPAIEVTGGAQPAAGAQAAGDAARESPAAGPEAAAAKPDLEELVALTPPSPFRDSVDSGSTTPNSPVSESALCIPSSPKYDTLIIRDYTQSSSSL

SEQ ID NO: 1019 - protein, 915 aa, homo sapiens
MVQLRKLLRVLTLMKFPCCVLEVLLCALAAAARGQEMYAPHSIRIEGDVTLGGLFPVHAKGPSGVPCGDIKRENGIHRLEAMLYALDQINSDPNLLPNVTLGARILDTCSRDTYALEQSLTFVQALIQKDTSDVRCTNGEPPVFVKPEKVVGVIGASGSSVSIMVANILRLFQIPQISYASTAPELSDDRRYDFFSRVVPPDSFQAQAMVDIVKALGWNYVSTLASEGSYGEKGVESFTQISKEAGGLCIAQSVRIPQERKDRTIDFDRIIKQLLDTPNSRAVVIFANDEDIKQILAAAKRADQVGHFLWVGSDSWGSKINPLHQHEDIAEGAITIQPKRATVEGFDAYFTSRTLENNRRNVWFAEYWEENFNCKLTISGSKKEDTDRKCTGQERIGKDSNYEQEGKVQFVIDAVYAMAHALHHMNKDLCADYRGVCPEMEQAGGKKLLKYIRNVNFNGSAGTPVMFNKNGDAPGRYDIFQYQTTNTSNPGYRLIGQWTDELQLNIEDMQWGKGVREIPASVCTLPCKPGQRKKTQKGTPCCWTCEPCDGYQYQFDEMTCQHCPYDQRPNENRTGCQDIPIIKLEWHSPWAVIPVFLAMLGIIATIFVMATFIRYNDTPIVRASGRELSYVLLTGIFLCYIITFLMIAKPDVAVCSFRRVFLGLGMCISYAALLTKTNRIYRIFEQGKKSVTAPRLISPTSQLAITSSLISVQLLGVFIWFGVDPPNIIIDYDEHKTMNPEQARGVLKCDITDLQIICSLGYSILLMVTCTVYAIKTRGVPENFNEAKPIGFTMYTTCIVWLAFIPIFFGTAQSAEKLYIQTTTLTISMNLSASVALGMLYMPKVYIIIFHPELNVQKRKRSFKAVVTAATMSSRLSHKPSDRPNGEAKTELCENVDPNSPAAKKKYVSYNNLVI

SEQ ID NO: 1020 - protein, 907 aa, homo sapiens
MDTSRLGVLLSLPVLLQLATGGSSPRSGVLLRGCPTHCHCEPDGRMLLRVDCSDLGLSELPSNLSVFTSYLDLSMNNISQLLPNPLPSLRFLEELRLAGNALTYIPKGAFTGLYSLKVLMLQNNQLRHVPTEALQNLRSLQSLRLDANHISYVPPSCFSGLHSLRHLWLDDNALTEIPVQAFRSLSALQAMTLALNKIHHIPDYAFGNLSSLVVLHLHNNRIHSLGKKCFDGLHSLETLDLNYNNLDEFPTAIRTLSNLKELGFHSNNIRSIPEKAFVGNPSLITIHFYDNPIQFVGRSAFQHLPELRTLTLNGASQITEFPDLTGTANLESLTLTGAQISSLPQTVCNQLPNLQVLDLSYNLLEDLPSFSVCQKLQKIDLRHNEIYEIKVDTFQQLLSLRSLNLAWNKIAIIHPNAFSTLPSLIKLDLSSNLLSSFPITGLHGLTHLKLTGNHALQSLISSENFPELKVIEMPYAYQCCAFGVCENAYKISNQWNKGDNSSMDDLHKKDAGMFQAQDERDLEDFLLDFEEDLKALHSVQCSPSPGPFKPCEHLLDGWLIRIGVWTIAVLALTCNALVTSTVFRSPLYISPIKLLIGVIAAVNMLTGVSSAVLAGVDAFTFGSFARHGAWWENGVGCHVIGFLSIFASESSVFLLTLAALERGFSVKYSAKFETKAPFSSLKVIILLCALLALTMAAVPLLGGSKYGASPLCLPLPFGEPSTMGYMVALILLNSLCFLMMTIAYTKLYCNLDKGDLENIWDCSMVKHIALLLFTNCILNCPVAFLSFSSLINLTFISPEVIKFILLVVVPLPACLNPLLYILFNPHFKEDLVSLRKQTYVWTRSKHPSLMSINSDDVEKQSCDSTQALVTFTSSSITYDLPPSSVPSPAYPVTESCHLSSVAFVPCL

SEQ ID NO: 1021 - protein, 487 aa, homo sapiens
MSLPNSSCLLEDKMCEGNKTTMASPQLMPLVVVLSTICLVTVGLNLLVLYAVRSERKLHTVGNLYIVSLSVADLIVGAVVMPMNILYLLMSKWSLGRPLCLFWLSMDYVASTASIFSVFILCIDRYRSVQQPLRYLKYRTKTRASATILGAWFLSFLWVIPILGWNHFMQQTSVRREDKCETDFYDVTWFKVMTAIINFYLPTLLMLWFYAKIYKAVRQHCQHRELINRSLPSFSEIKLRPENPKGDAKKPGKESPWEVLKRKPKDAGGGSVLKSPSQTPKEMKSPVVFSQEDDREVDKLYCFPLDIVHMQAAAEGSSRDYVAVNRSHGQLKTDEQGLNTHGASEISEDQMLGDSQSFSRTDSDTTTETAPGKGKLRSGSNTGLDYIKFTWKRLRSHSRQYVSGLHMNRERKAAKQLGFIMAAFILCWIPYFIFFMVIAFCKNCCNEHLHMFTIWLGYINSTLNPLIYPLCNENFKKTFKRILHIRS

SEQ ID NO: 1022 - protein, 390 aa, homo sapiens
MEEPGAQCAPPPPAGSETWVPQANLSSAPSQNCSAKDYIYQDSISLPWKVLLVMLLALITLATTLSNAFVIATVYRTRKLHTPANYLIASLAVTDLLVSILVMPISTMYTVTGRWTLGQVVCDFWLSSDITCCTASILHLCVIALDRYWAITDAVEYSAKRTPKRAAVMIALVWVFSISISLPPFFWRQAKAEEEVSECVVNTDHILYTVYSTVGAFYFPTLLLIALYGRIYVEARSRILKQTPNRTGKRLTRAQLITDSPGSTSSVTSINSRVPDVPSESGSPVYVNQVKVRVSDALLEKKKLMAARERKATKTLGIILGAFIVCWLPFFIISLVMPICKDACWFHLAIFDFFTWLGYLNSLINPIIYTMSNEDFKQAFHKLIRFKCTS

SEQ ID NO: 1023 - protein, 377 aa, homo sapiens
MSPLNQSAEGLPQEASNRSLNATETSEAWDPRTLQALKISLAVVLSVITLATVLSNAFVLTTILLTRKLHTPANYLIGSLATTDLLVSILVMPISIAYTITHTWNFGQILCDIWLSSDITCCTASILHLCVIALDRYWAITDALEYSKRRTAGHAATMIAIVWAISICISIPPLFWRQAKAQEEMSDCLVNTSQISYTIYSTCGAFYIPSVLLIILYGRIYRAARNRILNPPSLYGKRFTTAHLITGSAGSSLCSLNSSLHEGHSHSAGSPLFFNHVKIKLADSALERKRISAARERKATKILGIILGAFIICWLPFFVVSLVLPICRDSCWIHPALFDFFTWLGYLNSLINPIIYTVFNEEFRQAFQKIVPFRKAS

SEQ ID NO: 1024 - protein, 365 aa, homo sapiens
MNITNCTTEASMAIRPKTITEKMLICMTLVVITTLTTLLNLAVIMAIGTTKKLHQPANYLICSLAVTDLLVAVLVMPLSIIYIVMDRWKLGYFLCEVWLSVDMTCCTCSILHLCVIALDRYWAITNAIEYARKRTAKRAALMILTVWTISIFISMPPLFWRSHRRLSPPPSQCTIQHDHVIYTIYSTLGAFYIPLTLILILYYRIYHAAKSLYQKRGSSRHLSNRSTDSQNSFASCKLTQTFCVSDFSTSDPTTEFEKFHASIRIPPFDNDLDHPGERQQISSTRERKAARILGLILGAFILSWLPFFIKELIVGLSIYTVSSEVADFLTWLGYVNSLINPLLYTSFNEDFKLAFKKLIRCREHT

SEQ ID NO: 1025 - protein, 458 aa, homo sapiens
MVNLRNAVHSFLVHLIGLLVWQCDISVSPVAAIVTDIFNTSDGGRFKFPDGVQNWPALSIVIIIIMTIGGNILVIMAVSMEKKLHNATNYFLMSLAIADMLVGLLVMPLSLLAILYDYVWPLPRYLCPVWISLDVLFSTASIMHLCAISLDRYVAIRNPIEHSRFNSRTKAIMKIAIVWAISIGVSVPIPVIGLRDEEKVFVNNTTCVLNDPNFVLIGSFVAFFIPLTIMVITYCLTIYVLRRQALMLLHGHTEEPPGLSLDFLKCCKRNTAEEENSANPNQDQNARRRKKKERRPRGTMQAINNERKASKVLGIVFFVFLIMWCPFFITNILSVLCEKSCNQKLMEKLLNVFVWIGYVCSGINPLVYTLFNKIYRRAFSNYLRCNYKVEKKPPVRQIPRVAATALSGRELNVNIYRHTNEPVIEKASDNEPGIEMQVENLELPVNPSSVVSERISSV

SEQ ID NO: 1026 - protein, 440 aa, homo sapiens
MVPEPGPTANSTPAWGAGPPSAPGGSGWVAAALCVVIALTAAANSLLIALICTQPALRNTSNFFLVSLFTSDLMVGLVVMPPAMLNALYGRWVLARGLCLLWTAFDVMCCSASILNLCLISLDRYLLILSPLRYKLRMTPLRALALVLGAWSLAALASFLPLLLGWHELGHARPPVPGQCRLLASLPFVLVASGLTFFLPSGAICFTYCRILLAARKQAVQVASLTTGMASQASETLQVPRTPRPGVESADSRRLATKHSRKALKASLTLGILLGMFFVTWLPFFVANIVQAVCDCISPGLFDVLTWLGYCNSTMNPIIYPLFMRDFKRALGRFLPCPRCPRERQASLASPSLRTSHSGPRPGLSLQQVLPLPLPPDSDSDSDAGSGGSSGLRLTAQLLLPGEATQDPPLPTRAAAAVNFFNIDPAEPELRPHPLGIPTN

SEQ ID NO: 1027 - protein, 445 aa, homo sapiens
MMDVNSSGRPDLYGHLRSFLLPEVGRGLPDLSPDGGADPVAGSWAPHLLSEVTASPAPTWDAPPDNASGCGEQINYGRVEKVVIGSILTLITLLTIAGNCLVVISVCFVKKLRQPSNYLIVSLALADLSVAVAVMPFVSVTDLIGGKWIFGHFFCNVFIAMDVMCCTASIMTLCVISIDRYLGITRPLTYPVRQNGKCMAKMILSVWLLSASITLPPLFGWAQNVNDDKVCLISQDFGYTIYSTAVAFYIPMSVMLFMYYQIYKAARKSAAKHKFPGFPRVEPDSVIALNGIVKLQKEVEECANLSRLLKHERKNISIFKREQKAATTLGIIVGAFTVCWLPFFLLSTARPFICGTSCSCIPLWVERTFLWLGYANSLINPFIYAFFNRDLRTTYRSLLQCQYRNINRKLSAAGMHEALKLAERPERPEFVLQNADYCRKKGHDS

SEQ ID NO: 1028 - protein, 350 aa, homo sapiens
MSNITDPQMWDFDDLNFTGMPPADEDYSPCMLETETLNKYVVIIAYALVFLLSLLGNSLVMLVILYSRVGRSVTDVYLLNLALADLLFALTLPIWAASKVNGWIFGTFLCKVVSLLKEVNFYSGILLLACISVDRYLAIVHATRTLTQKRHLVKFVCLGCWGLSMNLSLPFFLFRQAYHPNNSSPVCYEVLGNDTAKWRMVLRILPHTFGFIVPLFVMLFCYGFTLRTLFKAHMGQKHRAMRVIFAVVLIFLLCWLPYNLVLLADTLMRTQVIQESCERRNNIGRALDATEILGFLHSCLNPIIYAFIGQNFRHGFLKILAMHGLVSKEFLARHRVTSYTSSSVNVSSNL

SEQ ID NO: 1029 - protein, 360 aa, homo sapiens
MEDFNMESDSFEDFWKGEDLSNYSYSSTLPPFLLDAAPCEPESLEINKYFVVIIYALVFLLSLLGNSLVMLVILYSRVGRSVTDVYLLNLALADLLFALTLPIWAASKVNGWIFGTFLCKVVSLLKEVNFYSGILLLACISVDRYLAIVHATRTLTQKRYLVKFICLSIWGLSLLLALPVLLFRRTVYSSNVSPACYEDMGNNTANWRMLLRILPQSFGFIVPLLIMLFCYGFTLRTLFKAHMGQKHRAMRVIFAVVLIFLLCWLPYNLVLLADTLMRTQVIQETCERRNHIDRALDATEILGILHSCLNPLIYAFIGQKFRHGLLKILAIHGLISKDSLPKDSRPSFVGSSSGHTSTTL

SEQ ID NO: 1030 - protein, 297 aa, homo sapiens
MKHIINSYENINNTARNNSDCPRVVLPEEIFFTISIVGVLENLIVLLAVFKNKNLQAPMYFFICSLAISDMLGSLYKILENILIILRNMGYLKPRGSFETTADDIIDSLFVLSLLGSIFSLSVIAADRYITIFHALRYHSIVTMRRTVVVLTVIWTFCTGTGITMVIFSHHVPTVITFTSLFPLMLVFILCLYVHMFLLARSHTRKISTLPRANMKGAITLTILLGVFIFCWAPFVLHVLLMTFCPSNPYCACYMSLFQVNGMLIMCNAVIDPFIYAFRSPELRDAFKKMIFCSRYW

SEQ ID NO: 1031 - protein, 384 aa, homo sapiens
MNSTLFSQVENHSVHSNFSEKNAQLLAFENDDCHLPLAMIFTLALAYGAVIILGVSGNLALIIIILKQKEMRNVTNILIVNLSFSDLLVAIMCLPFTFVYTLMDHWVFGEAMCKLNPFVQCVSITVSIFSLVLIAVERHQLIINPRGWRPNNRHAYVGIAVIWVLAVASSLPFLIYQVMTDEPFQNVTLDAYKDKYVCFDQFPSDSHRLSYTTLLLVLQYFGPLCFIFICYFKIYIRLKRRNNMMDKMRDNKYRSSETKRINIMLLSIVVAFAVCWLPLTIFNTVFDWNHQIIATCNHNLLFLLCHLTAMISTCVNPIFYGFLNKNFQRDLQFFFNFCDFRSRDDDYETIAMSTMHTDVSKTSLKQASPVAFKKINNNDDNEKI

SEQ ID NO: 1032 - protein, 381 aa, homo sapiens
MGPIGAEADENQTVEEMKVEQYGPQTTPRGELVPDPEPELIDSTKLIEVQVVLILAYCSIILLGVIGNSLVIHVVIKFKSMRTVTNFFIANLAVADLLVNTLCLPFTLTYTLMGEWKMGPVLCHLVPYAQGLAVQVSTITLTVIALDRHRCIVYHLESKISKRISFLIIGLAWGISALLASPLAIFREYSLIEIIPDFEIVACTEKWPGEEKSIYGTVYSLSSLLILYVLPLGIISFSYTRIWSKLKNHVSPGAANDHYHQRRQKTTKMLVCVVVVFAVSWLPLHAFQLAVDIDSQVLDLKEYKLIFTVFHIIAMCSTFANPLLYGWMNSNYRKAFLSAFRCEQRLDAIHSEVSVTFKAKKNLEVRKNSGPNDSFTEATNV

SEQ ID NO: 1033 - protein, 370 aa, homo sapiens
MEPLFPAPFWEVIYGSHLQGNLSLLSPNHSLLPPHLLLNASHGAFLPLGLKVTIVGLYLAVCVGGLLGNCLVMYVILRHTKMKTATNIYIFNLALADTLVLLTLPFQGTDILLGFWPFGNALCKTVIAIDYYNMFTSTFTLTAMSVDRYVAICHPIRALDVRTSSKAQAVNVAIWALASVVGVPVAIMGSAQVEDEEIECLVEIPTPQDYWGPVFAICIFLFSFIVPVLVISVCYSLMIRRLRGVRLLSGSREKDRNLRRITRLVLVVVAVFVGCWTPVQVFVLAQGLGVQPSSETAVAILRFCTALGYVNSCLNPILYAFLDENFKACFRKFCCASALRRDVQVSDRVRSIAKDVALACKTSETVPRPA

SEQ ID NO: 1034 - protein, 373 aa, homo sapiens
MTEVLWPAVPNGTDAAFLAGPGSSWGNSTVASTAAVSSSFKCALTKTGFQFYYLPAVYILVFIIGFLGNSVAIWMFVFHMKPWSGISVYMFNLALADFLYVLTLPALIFYYFNKTDWIFGDAMCKLQRFIFHVNLYGSILFLTCISAHRYSGVVYPLKSLGRLKKKNAICISVLVWLIVVVAISPILFYSGTGVRKNKTITCYDTTSDEYLRSYFIYSMCTTVAMFCVPLVLILGCYGLIVRALIYKDLDNSPLRRKSIYLVIIVLTVFAVSYIPFHVMKTMNLRARLDFQTPAMCAFNDRVYATYQVTRGLASLNSCVDPILYFLAGDTFRRRLSRATRKASRRSEANLQSKSEDMTLNILPEFKQNGDTSL

SEQ ID NO: 1035 - protein, 365 aa, homo sapiens
MASTESSLLRSLGLSPGPGSSEVELDCWFDEDFKFILLPVSYAVVFVLGLGLNAPTLWLFIFRLRPWDATATYMFHLALSDTLYVLSLPTLIYYYAAHNHWPFGTEICKFVRFLFYWNLYCSVLFLTCISVHRYLGICHPLRALRWGRPRLAGLLCLAVWLVVAGCLVPNLFFVTTSNKGTTVLCHDTTRPEEFDHYVHFSSAVMGLLFGVPCLVTLVCYGLMARRLYQPLPGSAQSSSRLRSLRTIAVVLTVFAVCFVPFHITRTIYYLARLLEADCRVLNIVNVVYKVTRPLASANSCLDPVLYLLTGDKYRRQLRQLCGGGKPQPRTAASSLALVSLPEDSSCRWAATPQDSSCSTPRADRL

SEQ ID NO: 1036 - protein, 342 aa, homo sapiens
MEPHDSSHMDSEFRYTLFPIVYSIIFVLGVIANGYVLWVFARLYPCKKFNEIKIFMVNLTMADMLFLITLPLWIVYYQNQGNWILPKFLCNVAGCLFFINTYCSVAFLGVITYNRFQAVTRPIKTAQANTRKRGISLSLVIWVAIVGAASYFLILDSTNTVPDSAGSGNVTRCFEHYEKGSVPVLIIHIFIVFSFFLVFLIILFCNLVIIRTLLMQPVQQQRNAEVKRRALWMVCTVLAVFIICFVPHHVVQLPWTLAELGFQDSKFHQAINDAHQVTLCLLSTNCVLDPVIYCFLTKKFRKHLTEKFYSMRSSRKCSRATTDTVTEVVVPFNQIPGNSLKN

SEQ ID NO: 1037 - protein, 488 aa, homo sapiens
MSTPGVNSSASLSPDRLNSPVTIPAVMFIFGVVGNLVAIVVLCKSRKEQKETTFYTLVCGLAVTDLLGTLLVSPVTIATYMKGQWPGGQPLCEYSTFILLFFSLSGLSIICAMSVERYLAINHAYFYSHYVDKRLAGLTLFAVYASNVLFCALPNMGLGSSRLQYPDTWCFIDWTTNVTAHAAYSYMYAGFSSFLILATVLCNVLVCGALLRMHRQFMRRTSLGTEQHHAAAAASVASRGHPAASPALPRLSDFRRRRSFRRIAGAEIQMVILLIATSLVVLICSIPLVVRVFVNQLYQPSLEREVSKNPDLQAIRIASVNPILDPWIYILLRKTVLSKAIEKIKCLFCRIGGSRRERSGQHCSDSQRTSSAMSGHSRSFISRELKEISSTSQTLLPDLSLPDLSENGLGGRNLLPGVPGMGLAQEDTTSLRTLRISETSDSSQGQDSESVLLVDEAGGSGRAGPAPKGSSLQVTFPSETLNLSEKCI

SEQ ID NO: 1038 - protein, 359 aa, homo sapiens
MSMNNSKQLVSPAAALLSNTTCQTENRLSVFFSVIFMTVGILSNSLAIAILMKAYQRFRQKSKASFLLLASGLVITDFFGHLINGAIAVFVYASDKEWIRFDQSNVLCSIFGICMVFSGLCPLLLGSVMAIERCIGVTKPIFHSTKITSKHVKMMLSGVCLFAVFIALLPILGHRDYKIQASRTWCFYNTEDIKDWEDRFYLLLFSFLGLLALGVSLLCNAITGITLLRVKFKSQQHRQGRSHHLEMVIQLLAIMCVSCICWSPFLVTMANIGINGNHSLETCETTLFALRMATWNQILDPWVYILLRKAVLKNLYKLASQCCGVHVISLHIWELSSIKNSLKVAAISESPVAEKSAST

SEQ ID NO: 1039 - protein, 386 aa, homo sapiens [sequence omitted]

SEQ ID NO: 1040 - protein, 593 aa, homo sapiens
MGTARIAPGLALLLCCPVLSSAYALVDADDVMTKEEQIFLLHRAQAQCEKRLKEVLQRPASIMESDKGWTSASTSGKPRKDKASGKLYPESEEDKEAPTGSRYRGRPCLPEWDHILCWPLGAPGEVVAVPCPDYIYDFNHKGHAYRRCDRNGSWELVPGHNRTWANYSECVKFLTNETREREVFDRLGMIYTVGYSVSLASLTVAVLILAYFRRLHCTRNYIHMHLFLSFMLRAVSIFVKDAVLYSGATLDEAERLTEEELRAIAQAPPPPATAAAGYAGCRVAVTFFLYFLATNYYWILVEGLYLHSLIFMAFFSEKKYLWGFTVFGWGLPAVFVAVWVSVRATLANTGCWDLSSGNKKWIIQVPILASIVLNFILFINIVRVLATKLRETNAGRCDTRQQYRKLLKSTLVLMPLFGVHYIVFMATPYTEVSGTLWQVQMHYEMLFNSFQGFFVAIIYCFCNGEVQAEIKKSWSRWTLALDFKRKARSGSSSYSYGPMVSHTSVTNVGPRVGLGLPLSPRLLPTATTNGHPQLPGHAKPGTPALETLETTPPAMAAPKDDGFLNGSCSGLDEEASGPERPPALLQEEWETVM

SEQ ID NO: 1041 - protein, 357 aa, homo sapiens
MATTVPDGCRNGLKSKYYRLCDKAEAWGIVLETVATAGVVTSVAFMLTLPILVCKVQDSNRRKMLPTQFLFLLGVLGIFGLTFAFIIGLDGSTGPTRFFLFGILFSICFSCLLAHAVSLTKLVRGRKPLSLLVILGLAVGFSLVQDVIAIEYIVLTMNRTNVNVFSELSAPRRNEDFVLLLTYVLFLMALTFLMSSFTFCGSFTGWKRHGAHIYLTMLLSIAIWVAWITLLMLPDFDRRWDDTILSSALAANGWVFLLAYVSPEFWLLTKQRNPMDYPVEDAFCKPQLVKKSYGVENRAYSQEEITQGFEETGDTLYAPYSTHFQLQNQPPQKEFSIPRAHAWPSPYKDYEVKKEGS

SEQ ID NO: 1042 - protein, 407 aa, homo sapiens
MDNVLPVDSDLSPNISTNTSEPNQFVQPAWQIVLWAAAYTVIVVTSVVGNVVVMWIILAHKRMRTVTNYFLVNLAFAEASMAAFNTVVNFTYAVHNEWYYGLFYCKFHNFFPIAAVFASIYSMTAVAFDRYMAIIHPLQPRLSATATKVVICVIWVLALLLAFPQGYYSTTETMPSRVVCMIEWPEHPNKIYEKVYHICVTVLIYFLPLLVIGYAYTVVGITLWASEIPGDSSDRYHEQVSAKRKVVKMMIVVVCTFAICWLPFHIFFLLPYINPDLYLKKFIQQVYLAIMWLAMSSTMYNPIIYCCLNDRFRLGFKHAFRCCPFISAGDYEGLEMKSTRYLQTQGSVYKVSRLETTISTVVGAHEEEPEDGPKATPSSLDLTSNCSSRSDSKTMTESFSFSSNVLS

SEQ ID NO: 1043 - protein, 343 aa, homo sapiens
MWPNGSSLGPCFRPTNITLEERRLIASPWFAASFCVVGLASNLLALSVLAGARQGGSHTRSSFLTFLCGLVLTDFLGLLVTGTIVVSQHAALFEWHAVDPGCRLCRFMGVVMIFFGLSPLLLGAAMASERYLGITRPFSRPAVASQRRAWATVGLVWAAALALGLLPLLGVGRYTVQYPGSWCFLTLGAESGDVAFGLLFSMLGGLSVGLSFLLNTVSVATLCHVYHGQEAAQQRPRDSEVEMMAQLLGIMVVASVCWLPLLVFIAQTVLRNPPAMSPAGQLSRTTEKELLIYLRVATWNQILDPWVYILFRRAVLRRLQPRLSTRPRSLSLQPQLTQRSGLQ

SEQ ID NO: 1044 - protein, 398 aa, homo sapiens
MENETVSELNQTQLQPRAVVALEYQVVTILLVLIICGLGIVGNIMVVLVVMRTKHMRTPTNCYLVSLAVADLMVLVAAGLPNITDSIYGSWVYGYVGCLCITYLQYLGINASSCSITAFTIERYIAICHPIKAQFLCTFSRAKKIIIFVWAFTSLYCMLWFFLLDLNISTYKDAIVISCGYKISRNYYSPIYLMDFGVFYVVPMILATVLYGFIARILFLNPIPSDPKENSKTWKNDSTHQNTNLNVNTSNRCFNSTVSSRKQVTKMLAVVVILFALLWMPYRTLVVVNSFLSSPFQENWFLLFCRICIYLNSAINPVIYNLMSQKFRAAFRKLCNCKQKPTEKPANYSVALNYSVIKESDHFSTELDDITVTDTYLSATKVSFDDTCLASEVSFSQS

SEQ ID NO: 1045 - protein, 477 aa, homo sapiens
MGAGVLVLGASEPGNLSSAAPLPDGAATAARLLVPASPPASLLPPASESPEPLSQQWTAGMGLLMALIVLLIVAGNVLVIVAIAKTPRLQTLTNLFIMSLASADLVMGLLVVPFGATIVVWGRWEYGSFFCELWTSVDVLCVTASIETLCVIALDRYLAITSPFRYQSLLTRARARGLVCTVWAISALVSFLPILMHWWRAESDEARRCYNDPKCCDFVTNRAYAIASSVVSFYVPLCIMAFVYLRVFREAQKQVKKIDSCERRFLGGPARPPSPSPSPVPAPAPPPGPPRPAAAAATAPLANGRAGKRRPSRLVALREQKALKTLGIIMGVFTLCWLPFFLANVVKAFHRELVPDRLFVFFNWLGYANSAFNPIIYCRSPDFRKAFQGLLCCARRAARRRHATHGDRPRASGCLARPGPPPSPGAASDDDDDDVVGATPPARLLEPWAGCNGGAAADSDSSLDEPCRPGFASESKV

SEQ ID NO: 1046 - protein, 408 aa, homo sapiens
MAPWPHENSSLAPWPDLPTLAPNTANTSGLPGVPWEAALAGALLALAVLATVGGNLLVIVAIAWTPRLQTMTNVFVTSLAAADLVMGLLVVPPAATLALTGHWPLGATGCELWTSVDVLCVTASIETLCALAVDRYLAVTNPLRYGALVTKRCARTAVVLVWVVSAAVSFAPIMSQWWRVGADAEAQRCHSNPRCCAFASNMPYVLLSSSVSFYLPLLVMLFVYARVFVVATRQLRLLRGELGRFPPEESPPAPSRSLAPAPVGTCAPPEGVPACGRRPARLLPLREHRALCTLGLIMGTFTLCWLPFFLANVLRALGGPSLVPGPAFLALNWLGYANSAFNPLIYCRSPDFRSAFRRLLCRCGRRLPPEPCAAARPALFPSGVPAARSSPAQPRLCQRLDGASWGVS

SEQ ID NO: 1047 - protein, 371 aa, homo sapiens
MLMASTTSAVPGHPSLPSLPSNSSQERPLDTRDPLLARAELALLSIVFVAVALSNGLVLAALARRGRRGHWAPIHVFIGHLCLADLAVALFQVLPQLAWKATDRFRGPDALCRAVKYLQMVGMYASSYMILAMTLDRHRAICRPMLAYRHGSGAHWNRPVLVAWAFSLLLSLPQLFIFAQRNVEGGSGVTDCWACFAEPWGRRTYVTWIALMVFVAPTLGIAACQVLIFREIHASLVPGPSERPGGRRRGRRTGSPGEGAHVSAAVAKTVRMTLVIVVVYVLCWAPFFLVQLWAAWDPEAPLEGAPFVLLMLLASLNSCTNPWIYASFSSSVSSELRSLLCCARGRTPPSLGPQDESCTTASSSLAKDTSS

SEQ ID NO: 1048 - protein, 391 aa, homo sapiens
MFSPWKISMFLSVREDSVPTTASFSADMLNVTLQGPTLNGTFAQSKCPQVEWLGWLNTIQPPFLWVLFVLATLENIFVLSVFCLHKSSCTVAEIYLGNLAAADLILACGLPFWAITISNNFDWLFGETLCRVVNAIISMNLYSSICFLMLVSIDRYLALVKTMSMGRMRGVRWAKLYSLVIWGCTLLLSSPMLVFRTMKEYSDEGHNVTACVISYPSLIWEVFTNMLLNVVGFLLPLSVITFCTMQIMQVLRNNEMQKFKEIQTERRATVLVLVVLLLFIICWLPFQISTFLDTLHRLGILSSCQDERIIDVITQIASFMAYSNSCLNPLVYVIVGKRFRKKSWEVYQGVCQKGGCRSEPIQMENSMGTLRTSISVERQIHKLQDWAGSRQ

SEQ ID NO: 1049 - protein, 442 aa, homo sapiens
MQPPPSLCGRALVALVLACGLSRIWGEERGFPPDRATPLLQTAEIMTPPTKTLWPKGSNASLARSLAPAEVPKGDRTAGSPPRTISPPPCQGPIEIKETFKYINTVVSCLVFVLGIIGNSTLLRIIYKNKCMRNGPNILIASLALGDLLHIVIDIPINVYKLLAEDWPFGAEMCKLVPFIQKASVGITVLSLCALSIDRYRAVASWSRIKGIGVPKWTAVEIVLIWVVSVVLAVPEAIGFDIITMDYKGSYLRICLLHPVQKTAFMQFYKTAKDWWLFSFYFCLPLAITAFFYTLMTCEMLRKKSGMQIALNDHLKQRREVAKTVFCLVLVFALCWLPLHLSRILKLTLYNQNDPNRCELLSFLLVLDYIGINMASLNSCINPIALYLVSKRFKNCFKSCLCCWCQSFEEKQSLEEKQSCLKFKANDHGYDNFRSSNKYSSS

SEQ ID NO: 1050 - protein, 391 aa, homo sapiens
MFPNGTASSPSSSPSPSPGSCGEGGGSRGPGAGAADGMEEPGRNASQNGTLSEGQGSAILISFIYSVVCLVGLCGNSMVIYVILRYAKMKTATNIYILNLAIADELLMLSVPFLVTSTLLRHWPFGALLCRLVLSVDAVNMFTSIYCLTVLSVDRYVAVVHPIKAARYRRPTVAKVVNLGVWVLSLLVILPIVVFSRTAANSDGTVACNMLMPEPAQRWLVGFVLYTFLMGFLLPVGAICLCYVLIIAKMRMVALKAGWQQRKRSERKITLMVMMVVMVFVICWMPFYVVQLVNVFAEQDDATVSQLSVILGYANSCANPILYGFLSDNFKRSFQRILCLSWMDNAAEEPVDYYATALKSRAYSVEDFQPENLESGGVFRNGTCTSRITTL

SEQ ID NO: 1051 - protein, 369 aa, homo sapiens
MDMADEPLNGSHTWLSIPFDLNGSVVSTNTSNQTEPYYDLTSNAVLTFIYFVVCIIGLCGNTLVIYVILRYAKMKTITNIYILNLAIADELFMLGLPFLAMQVALVHWPFGKAICRVVMTVDGINQFTSIFCLTVMSIDRYLAVVHPIKSAKWRRPRTAKMITMAVWGVSLLVILPIMIYAGLRSNQWGRSSCTINWPGESGAWYTGFIIYTFILGFLVPLTIICLCYLFIIIKVKSSGIRVGSSKRKKSEKKVTRMVSIVVAVFIFCWLPFYIFNVSSVSMAISPTPALKGMFDFVVVLTYANSCANPILYAFLSDNFKKSFQNVLCLVKVSGTDDGERSDSKQDKSRLNETTETQRTLLNGDLQTSI

SEQ ID NO: 1052 - protein, 418 aa, homo sapiens
MDMLHPSSVSTTSEPENASSAWPPDATLGNVSAGPSPAGLAVSGVLIPLVYLVVCVVGLLGNSLVIYVVLRHTASPSVTNVYILNLALADELFMLGLPFLAAQNALSYWPFGSLMCRLVMAVDGINQFTSIFCLTVMSVDRYLAVVHPTRSARWRTAPVARTVSAAVWVASAVVVLPVVVFSGVPRGMSTCHMQWPEPAAAWRAGFIIYTAALGFFGPLLVICLCYLLIVVKVRSAGRRVWAPSCQRRRRSERRVTRMVVAVVALFVLCWMPFYVLNIVNVVCPLPEEPAFFGLYFLVVALPYANSCANPILYGFLSYRFKQGFRRVLLRPSRRVRSQEPTVGPPEKTEEEDEEEEDGEESREGGKGKEMNGRVSQITQPGTSGQERPPSRVASKEQQLLPQEASTGEKSSTMRISYL

SEQ ID NO: 1053 - protein, 364 aa, homo sapiens
MEPLFPASTPSWNASSPGAASGGGDNRTLVGPAPSAGARAVLVPVLYLLVCAAGLGGNTLVIYVVLRFAKMKTVTNIYILNLAVADVLYMLGLPFLATQNAASFWPFGPVLCRLVMTLDGVNQFTSVFCLTVMSVDRYLAVVHPLSSARWRRPRVAKLASAAAWVLSLCMSLPLLVFADVQEGGTCNASWPEPVGLWGAVFIIYTAVLGFFAPLLVICLCYLLIVVKVRAAGVRVGCVRRRSERKVTRMVLVVVLVFAGCWLPFFTVNIVNLAVALPQEPASAGLYFFVVILSYANSCANPVLYGFLSDNFRQSFQKVLCLRKGSGAKDADATEPRPDRIRQQQEATPPAHRAAANGLMQTSKL

SEQ ID NO: 1054 - protein, 482 aa, homo sapiens
MASFSAETNSTDLLSQPWNEPPVILSMVILSLTFLLGLPGNGLVLWVAGLKMQRTVNTIWFLHLTLADLLCCLSLPFSLAHLALQGQWPYGRFLCKLIPSIIVLNMFASVFLLTAISLDRCLVVFKPIWCQNHRNVGMACSICGCIWVVAFVMCIPVFVYREIFTTDNHNRCGYKFGLSSSLDYPDFYGDPLENRSLENIVQPPGEMNDRLDPSSFQTNDHPWTVPTVFQPQTFQRPSADSLPRGSARLTSQNLYSNVFKPADVVSPKIPSGFPIEDHETSPLDNSDAFLSTHLKLFPSASSNSFYESELPQGFQDYYNLGQFTDDDQVPTPLVAITITRLVVGFLLPSVIMIACYSFIVFRMQRGRFAKSQSKTFRVAVVVVAVFLVCWTPYHIFGVLSLLTDPETPLGKTLMSWDHVCIALASANSCFNPFLYALLGKDFRKKARQSIQGILEAAFSEELTRSTHCPSNNVISERNSTTV

SEQ ID NO: 1055 - protein, 371 aa, homo sapiens
MEDEDYNTSISYGDEYPDYLDSIVVLEDLSPLEARVTRIFLVVVYSIVCFLGILGNGLVIIIATFKMKKTVNMVWFLNLAVADFLFNVFLPIHITYAAMDYHWVFGTAMCKISNFLLIHNMFTSVFLLTIISSDRCISVLLPVWSQNHRSVRLAYMACMVIWVLAFFLSSPSLVFRDTANLHGKISCFNNFSLSTPGSSSWPTHSQMDPVGYSRHMVVTVTRFLCGFLVPVLIITACYLTIVCKLQRNRLAKTKKPFKIIVTIIITFFLCWCPYHTLNLLELHHTAMPGSVFSLGLPLATALAIANSCMNPILYVFMGQDFKKFKVALFSRLVNALSEDTGHSSYPSHRSFTKMSSMNERTSMNERETGML

SEQ ID NO: 1056 - protein, 374 aa, homo sapiens
MKALIFAAAGLLLLLPTFCQSGMENDTNNLAKPTLPIKTFRGAPPNSFEEFPFSALEGWTGATITVKIKCPEESASHLHVKNATMGYLTSSLSTKLIPAIYLLVFVVGVPANAVTLWMLFFRTRSICTTVFYTNLAIADFLFCVTLPFKIAYHLNGNNWVFGEVLCRATTVIFYGNMYCSILLLACISINRYLAIVHPFTYRGLPKHTYALVTCGLVWATVFLYMLPFFILKQEYYLVQPDITTCHDVHNTCESSSPFQLYYFISLAFFGFLIPFVLIIYCYAAIIRTLNAYDHRWLWYVKASLLILVIFTICFAPSNIILIIHHANYYYNNTDGLYFIYLIALCLGSLNSCLDPFLYFLMSKTRNHSTAYLTK

SEQ ID NO: 1057 - protein, 553 aa, homo sapiens
MKLGSSRAGPGRGSAGLLPGVHELPMGIPAPWGTSPLSFHRKCSLWAPGRPFLTLVLLVSIKQVTGSLLEETTRKWAQYKQACLRDLLKEPSGIFCNGTFDQYVCWPHSSPGNVSVPCPSYLPWWSEESSGRAYRHCLAQGTWQTIENATDIWQDDSECSENHSFKQNVDRYALLSTLQLMYTVGYSFSLISLFLALTLLLFLRKLHCTRNYIHMNLFASFILRTLAVLVKDVVFYNSYSKRPDNENGWMSYLSEMSTSCRSVQVLLHYFVGANYLWLLVEGLYLHTLLEPTVLPERRLWPRYLLLGWAFPVLFVVPWGFARAHLENTGCWTTNGNKKIWWIIRGPMMLCVTVNFFIFLKILKLLISKLKAHQMCFRDYKYRLAKSTLVLIPLLGVHEILFSFITDDQVEGFAKLIRLFIQLTLSSFHGFLVALQYGFANGEVKAELRKYWVRFLLARHSGCRACVLGKDFRFLGKCPKKLSEGDGAEKLRKLQPSLNSGRLLHLAMRGLGELGAQPQQDHARWPRGSSLSECSEGDVTMANTMEEILEESEI

SEQ ID NO: 1058 - protein, 370 aa, homo sapiens
MASSTTRGPRVSDLFSGLPPAVTTPANQSAEASAGNGSVAGADAPAVTPFQSLQLVHQLKGLIVLLYSVVVVVGLVGNCLLVLVIARVRRLHNVTNFLIGNLALSDVLMCTACVPLTLAYAFEPRGWVFGGGLCHLVFFLQPVTVYVSVFTLTTIAVDRYVVLVHPLRRRISLRLSAYAVLAIWALSAVLALPAAVHTYHVELKPHDVRLCEEFWGSQERQRQLYAWGLLLVTYLLPLLVILLSYVRVSVKLRNRVVPGCVTQSQADWDRARRRRTFCLLVVVVVVFAVCWLPLHVFNLLRDLDPHAIDPYAFGLVQLLCHWLAMSSACYNPFIYAWLHDSFREELRKLLVAWPRKIAPHGQNMTVSVVI

SEQ ID NO: 1059 - protein, 328 aa, homo sapiens
MEWDNGTGQALGLPPTTCVYRENFKQLLLPPVYSAVLAAGLPLNICVITQICTSRRALTRTAVYTLNLALADLLYACSLPLLIYNYAQGDHWPFGDFACRLVRFLFYANLHGSILFLTCISFQRYLGICHPLAPWHKRGGRRAAWLVCVAVWLAVTTQCLPTAIFAATGIQRNRTVCYDLSPPALATHYMPYGMALTVIGFLLPFAALLACYCLLACRLCRQDGPAEPVAQERRGKAARMAVVVAAAFAISFLPFHITKTAYLAVRSTPGVPCTVLEAFAAAYKGTRPFASANSVLDPILFYFTQKKFRRRPHELLQKLTAKWQRQGR

SEQ ID NO: 1060 - protein, 361 aa, homo sapiens [sequence omitted]

SEQ ID NO: 1061 - protein, 550 aa, homo sapiens
MAGLGASLHVWGWLMLGSCLLARAQLDSDGTITIEEQIVLVLKAKVQCELNITAQLQEGEGNCFPEWDGLICWPRGTVGKISAVPCPPYIYDFNHKGVAFRHCNPNGTWDFMHSLNKTWANYSDCLRFLQPDISIGKQEFFERLYVMYTVGYSISFGSLAVAILIIGYFRRLHCTRNYIHMHLFVSFMLRATSIFVKDRVVHAHIGVKELESLIMQDDPQNSIEATSVDKSQYIGCKIAVVMFIYFLATNYYWILVEGLYLHNLIFVAFFSDTKYLWGFILIGWGFPAAFVAAWAVARATLADARCWELSAGDIKWIYQAPILAAIGLNFILFLNTVRVLATKIWETNAVGHDTRKQYRKLAKSTLVLVLVFGVHYIVFVCLPHSFTGLGWEIRMHCELFFNSFQGFFVSIIYCYCNGEVQAEVKKMWSRWNLSVDWKRTPPCGSRRCGSVLTTVTHSTSSQSQVAASTRMVLISGKAAKIASRQPDSHITLPGYVWSNSEQDCLPHSFHEETKEDSGRQGDDILMEKPSRPMESNPDTEGCQGETEDVL

SEQ ID NO: 1062 - protein, 380 aa, homo sapiens
MEEGGDFDNYYGADNQSECEYTDWKSSGALIPAIYMLVFLLGTTGNGLVLWTVFRSSREKRRSADIFIASLAVADLTFVVTLPLWATYTYRDYDWPFGTFFCKLSSYLIFVNMYASVFCLTGLSFDRYLAIVRPVANARLRLRVSGAVATAVLWVLAALLAMPVMVLRTTGDLENTTKVQCYMDYSMVATVSSEWAWEVGLGVSSTTVGFVVPFTIMLTCYFFIAQTIAGHFRKERIEGLRKRRRLLSIIVVLVVTFALCWMPYHLVKTLYMLGSLLHWPCDFDLFLMNIFPYCTCISYVNSCLNPFLYAFFDPRFRQACTSMLCCGQSRCAGTSHSSSGEKSASYSSGHSQGPGPNMGKGGEQMHEKSIPYSQETLVVD

SEQ ID NO: 1063 - protein, 355 aa, homo sapiens
MDYTLDLSVTTVTDYYYPDIFSSPCDAELIQTNGKLLLAVFYCLLFVFSLLGNSLVILVLVVCKKLRSITDVYLLNLALSDLLFVFSFPFQTYYLLDQWVFGTVMCKVVSGFYYIGFYSSMFFITLMSVDRYLAVVHAVYALKVRTIRMGTTLCLAVWLTAIMATIPLLVFYQVASEDGVLQCYSFYNQQTLKWKIFTNFKMNILGLLIPFTIFMFCYIKILHQLKRCQNHNKTKAIRLVLIVVIASLLFWVPFNVVLFLTSLHSMHILDGCSISQQLTYATHVTEIISFTHCCVNPVIYAFVGEKFKKHLSEIFQKSCSQIFNYLGRQMPRESCEKSSSCQQHSSRSSSVDYIL

SEQ ID NO: 1064 - protein, 334 aa, homo sapiens
MNEDLKVNLSGLPRDYLDAAAAENISAAVSSRVPAVEPEPELVVNPWDIVLCTSGTLISCENAIVVLIIFHNPSLRAPMFLLIGSLALADLLAGIGLITNFVFAYLLQSEATKLVTIGLIVASFSASVCSLLAITVDRYLSLYYALTYHSERTVTFTYVMLVMLWGTSICLGLLPVMGWNCLRDESTCSVVRPLTKNNAAILSVSFLFMFALMLQLYIQICKIVMRHAHQIALQHHFLATSHYVTTRKGVSTLAIILGTFAACWMPFTLYSLIADYTYPSIYTYATLLPATYNSIINPVIYAFRNQEIQKALCLICCGCIPSSLAQRARSPSDV

SEQ ID NO: 1065 - protein, 360 aa, homo sapiens
MDPEETSVYLDYYYATSPNSDIRETHSHVPYTSVFLPVFYTAVFLTGVLGNLVLMGALHFKPGSRRLIDIFIINLAASDFIFLVTLPLWVDKEASLGLWRTGSFLCKGSSYMISVNMHCSVLLLTCMSVDRYLAIVWPVVSRKFRRTDCAYVVCASIWFISCLLGLPTLLSRELTLIDDKPYCAEKKATPIKLIWSLVALIFTFFVPLLSIVTCYCCIARKLCAHYQQSGKHNKKLKKSIKIIFIVVAAFLVSWLPFNTFKFLAIVSGLRQEHYLPSAILQLGMEVSGPLAFANSCVNPFIYYIFDSYIRRAIVHCLCPCLKNYDFGSSTETSDSHLTKALSTFIHAEDFARRRKRSVSL

SEQ ID NO: 1066 - protein, 367 aa, homo sapiens
MSKRSWWAGSRKPPREMLKLSGSDSSQSMNGLEVAPPGLITNFSLATAEQCGQETPLENMLFASFYLLDFILALVGNTLALWLFIRDHKSGTPANVFLMHLAVADLSCVLVLPTRLVYHFSGNHWPFGEIACRLTGFLFYLNMYASIYFLTCISADRFLAIVHPVKSLKLRRPLYAHLACAFLWVVVAVAMAPLLVSPQTVQTNHTVVCLQLYREKASHHALVSLAVAFTFPFITTVTCYLLIIRSLRQGLRVEKRLKTKAVRMIAIVLAIFLVCFVPYHVNRSVYVLHYRSHGASCATQRILALANRITSCLTSLNGALDPIMYFFVAEKFRHALCNLLCGKRLKGPPPSFEGKTNESSLSAKSEL

SEQ ID NO: 1067 - protein, 349 aa, homo sapiens
MNSTLDGNQSSHPFCLLAFGYLETVNFCLLEVLIIVFLTVLIISGNIIVIFVFHCAPLLNHHTTSYFIQTMAYADLFVGVSCVVPSLSLLHHPLPVEESLTCQIFGFVVSVLKSVSMASLACISIDRYIAITKPLTYNTLVTPWRLRLCIFLIWLYSTLVFLPSFFHWGKPGYHGDVFQWCAESWHTDSYFTLFIVMMLYAPAALIVCFTYFNIFRICQQHTKDISERQARFSSQSGETGEVQACPDKRYAMVLFRITSVFYILWLPYIIYFLLESSTGHSNRFASFLTTWLAISNSFCNCVIYSLSNSVFQRGLKRLSGAMCTSCASQTTANDPYTVRSKGPLNGCHI

SEQ ID NO: 1068 - protein, 370 aa, homo sapiens
MGDRRFIDFQFQDSNSSLRPRLGNATANNTCIVDDSFKYNLNGAVYSVVFILGLITNSVSLFVFCFRMKMRSETAIFITNLAVSDLLFVCTLPFKIFYNFNRHWPFGDTLCKISGTAFLTNIYGSMLFLTCISVDRFLAIVYPFRSRTIRTRRNSAIVCAGVWILVLSGGISASLFSTTNVNNATTTCFEGFSKRVWKTYLSKITIFIEVVGFIIPLILNVSCSSVVLRTLRKPATLSQIGTNKKKVLKMITVHMAVFVVCFVPYNSVLFLYALVRSQAITNCFLERFAKIMYPITLCLATLNCCFDPFIYYFTLESFQKSFYINAHIRMESLFKTETPLTTKPSLPAIQEEVSDQTTNNGGELMLESTF

SEQ ID NO: 1069 - protein, 381 aa, homo sapiens
MRSHTITMTTTSVSSWPYSSHRMRFITNHSDQPPQNFSATPNVTTCPMDEKLLSTVLTTSYSVIFIVGLVGNIIALYVFLGIHRKRNSIQIYLLNVAIADLLLIFCLPFRIMYHINQNKWTLGVILCKVVGTLFYMNMYISIILLGFISLDRYIKINRSIQQRKAITTKQSIYVCCIVWMLALGGFLTMIILTLKKGGHNSTMCFHYRDKHNAKGEAIFNFILVVMFWLIFLLIILSYIKIGKNLLRISKRRSKFPNSGKYATTARNSFIVLIIFTICFVPYHAFRFIYISSQLNVSSCYWKEIVHKTNEIMLVLSSFNSCLDPVMYFLMSSNIRKIMCQLLFRRFQGEPSRSESTSEFKPGYSLHDTSVAVKIQSSSKST

SEQ ID NO: 1070 - protein, 613 aa, homo sapiens
MRAPGALLARMSRLLLLLLLKVSASSALGVAPASRNETCLGESCAPTVIQRRGRDAWGPGNSARDVLRARAPREEQGAAFLAGPSWDLPAAPGRDPAAGRGAEASAAGPPGPPTRPPGPWRWKGARGQEPSETLGRGNPTALQLFLQISEEEEKGPRGAGISGRSQEQSVKTVPGASDLFYWPRRAGKLQGSHHKPLSKTANGLAGHEGWTIALPGRALAQNGSLGEGIHEPGGPRRGNSTNRRVRLKNPFYPLTQESYGAYAVMCLSVVIFGTGIIGNLAVMCIVCHNYYMRSISNSLLANLAFWDFLIIFFCLPLVIFHELTKKWLLEDFSCKIVPYIEVASLGVTTFTLCALCIDRFRAATNVQMYYEMIENCSSTTAKLAVIWVGALLLALPEVVLRQLSKEDLGFSGRAPAERCIIKISPDLPDTIYVLALTYDSARLWWYFGCYFCLPTLFTITCSLVTARKIRKAEKACTRGNKRQIQLESQMNCTVVALTILYGFCIIPENICNIVTAYMATGVSQQTMDLLNIISQFLLFFKSCVTPVLLFCLCKPFSRAFMECCCCCCEECIQKSSTVTSDDNDNEYTTELELSPFSTIRREMSTFASVGTHC

SEQ ID NO: 1071 - protein, 330 aa, homo sapiens
MMWGAGSPLAWLSAGSGNVNVSSVGPAEGPTGPAAPLPSPKAWDVVLCISGTLVSCENALVVAIIVGTPAFRAPMFLLVGSLAVADLLAGLGLVLHFAAVFCIGSAEMSLVLVGVLAMAFTASIGSLLAITVDRYLSLYNALTYYSETTVTRTYVMLALVWGGALGLGLLPVLAWNCLDGLTTCGVVYPLSKNHLVVLAIAFFMVFGIMLQLYAQICRIVCRHAQQIALQRHLLPASHYVATRKGIATLAVVLGAFAACWLPFTVYCLLGDAHSPPLYTYLTLLPATYNSMINPIIYAFRNQDVQKVLWAVCCCCSSSKIPFRSRSPSDV

SEQ ID NO: 1072 - protein, 300 aa, homo sapiens
MDLPPQLSFGLYVAAFALGFPLNVLAIRGATAHARLRLTPSLVYALNLGCSDLLLTVSLPLKAVEALASGAWPLPASLCPVFAVAHFFPLYAGGGFLAALSAGRYLGAAFPLGYQAFRRPCYSWGVCAAIWALVLCHLGLVFGLEAPGGWLDHSNTSLGINTPVNGSPVCLEAWDPASAGPARFSLSLLLFFLPLAITAFCYVGCLRALARSGLTHRRKLRAAWVAGGALLTLLLCVGPYNASNVASFLYPNLGGSWRKLGLITGAWSVVLNPLVTGYLGRGPGLKTVCAARTQGGKSQK

SEQ ID NO: 1073 - protein, 346 aa, homo sapiens
MDTGPDQSYFSGNHWFVFSVYLLTFLVGLPLNLLALVVFVGKLQRRPVAVDVLLLNLTASDLLLLLFLPFRMVEAANGMHWPLPFILCPLSGFIFFTTIYLTALFLAAVSIERFLSVAHPLWYKTRPRLGQAGLVSVACWLLASAHCSVVYVIEFSGDISHSQGTNGTCYLEFRKDQLAILLPVRLEMAVVLFVVPLIITSYCYSRLVWILGRGGSHRRQRRVAGLLAATLLNFLVCFGPYNVSHVVGYICGESPAWRIYVTLLSTLNSCVDPFVYYFSSSGFQADFHELLRRLCGLWGQWQQESSMELKEQKGGEEQRADRPAERKTSEHSQGCGTGGQVACAES

SEQ ID NO: 1074 - protein, 330 aa, homo sapiens
MLPDWKSSLILMAYIIIFLTGLPANLLALRAFVGRIRQPQPAPVHILLLSLTLADLLLLLLLPFKIIEAASNFRWYLPKVVCALTSFGFYSSIYCSTWLLAGISIERYLGVAFPVQYKLSRRPLYGVIAALVAWVMSFGHCTIVIIVQYLNTTEQVRSGNEITCYENFTDNQLDVVLPVRLELCLVLFFIPMAVTIFCYWRFVWIMLSQPLVGAQRRRRAVGLAVVTLLNFLVCFGPYNVSHLVGYHQRKSPWWRSIAVVFSSLNASLDPLLFYFSSSVVRRAFGRGLQVLRNQGSSLLGRRGKDTAEGTNEDRGVGQGEGMPSSDFTTE

SEQ ID NO: 1075 - protein, 362 aa, homo sapiens
MGNHTWEGCHVDSRVDHLFPPSLYIFVIGVGLPTNCLALWAAYRQVQQRNELGVYLMNLSIADLLYICTLPLWVDYFLHHDNWIHGPGSCKLFGFIFYTNIYISIAFLCCISVDRYLAVAHPLRFARLRRVKTAVAVSSVVWATELGANSAPLFHDELFRDRYNHTFCFEKFPMEGWVAWMNLYRVFVGFLFPWALMLLSYRGILRAVRGSVSTERQEKAKIKRLALSLIAIVLVCFAPYHVLLLSRSAIYLGRPWDCGFEERVFSAYHSSLAFTSLNCVADPILYCLVNEGARSDVAKALHNLLRFLASDKPQEMANASLTLETPLTSKRNSTAKAMTGSWAATPPSQGDQVQLKMLPPAQ

SEQ ID NO: 1076 - protein, 333 aa, homo sapiens
MESSGNPESTTFFYYDLQSQPCENQAWVFATLATTVLYCLVFLLSLVGNSLVLWVLVKYESLESLTNIFILNLCLSDLVFACLLPVWISPYHWGWVLGDFLCKLLNMIFSISLYSSIFFLTIMTIHRYLSVVSPLSTLRVPTLRCRVLVTMAVWVASILSSILDTIFHKVLSSGCDYSELTWYLTSVYQHNLFFLLSLGIILFCYVEILRTLFRSRSKRRHRTVKLIFAIVVAYFLSWGPYNFTLFLQTLFRTQIIRSCEAKQQLEYALLICRNLAFSHCCFNPVLYVFVGVKFRTHLKHVLRQFWFCRLQAPSPASIPHSPGAFAYEGASFY

SEQ ID NO: 1077 - protein, 362 aa, homo sapiens
MNASAASLNDSQVVVVAAEGAAAAATAAGGPDTGEWGPPAAAALGAGGGANGSLELSSQLSAGPPGLLLPAVNPWDVLLCVSGTVIAGENALVVALIASTPALRTPMFVLVGSLATADLLAGCGLILHFVFQYLVPSETVSLLTVGFLVASFAASVSSLLAITVDRYLSLYNALTYYSRRTLLGVHLLLAATWTVSLGLGLLPVLGWNCLAERAACSVVRPLARSHVALLSAAFFMVFGIMLHLYVRICQVVWRHAHQIALQQHCLAPPHLAATRKGVGTLAVVLGTFGASWLPFAIYCVVGSHEDPAVYTYATLLPATYNSMINPIIYAFRNQEIQRALWLLLCGCFQSKVPFRSRSPSEV

SEQ ID NO: 1078 - protein, 384 aa, homo sapiens
MALNDCFLLNLEVDHFMHCNISSHSADLPVNDDWSHPGILYVIPAVYGVIILIGLIGNITLIKIFCTVKSMRNVPNLFISSLALGDLLLLITCAPVDASRYLADRWLFGRIGCKLIPFIQLTSVGVSVFTLTALSADRYKAIVRPMDIQASHALMKICLKAAFIWIISMLLAIPEAVFSDLHPFHEESTNQTFISCAPYPHSNELHPKIHSMASFLVFYVIPLSIISVYYYFIAKNLIQSAYNLPVEGNIHVKKQIESRKRLAKTVLVFVGLFAFCWLPNHVIYLYRSYHYSEVDTSMLHFVTSICARLLAFTNSCVNPFALYLLSKSFRKQFNTQLLCCQPGLIIRSHSTGRSTTCMTSLKSTNPSVATFSLINGNICHERYV

SEQ ID NO: 1079 - protein, 461 aa, homo sapiens [sequence omitted]

SEQ ID NO: 1080 - protein, 360 aa, homo sapiens
MNPTDIADTTLDESIYSNYYLYESIPKPCTKEGIKAFGELFLPPLYSLVFVFGLLGNSVVVLVLFKYKRLRSMTDVYLLNLAISDLLFVFSLPFWGYYAADQWVFGLGLCKMISWMYLVGFYSGIFFVMLMSIDRYLAIVHAVFSLRARTLTYGVITSLATWSVAVFASLPGFLFSTCYTERNHTYCKTKYSLNSTTWKVLSSLEINILGLVIPLGIMLFCYSMIIRTLQHCKNEKKNKAVKMIFAVVVLFLGFWTPYNIVLFLETLVELEVLQDCTFERYLDYAIQATETLAFVHCCLNPIIYFFLGEKFRKYILQLFKTCRGLFVLCQYCGLLQIYSADTPSSSYTQSTMDHDLHDAL

SEQ ID NO: 1081 - protein, 325 aa, homo sapiens
MNSSFHLHFLDLNLNATEGNLSGPNVKNKSSPCEDMGIAVEVFLTLGVISLLENILVIGAIVKNKNLHSPMYFFVCSLAVADMLVSMSSAWETITIYLLNNKHLVIADAFVRHIDNVFDSMICISVVASMCSLLAIAVDRYVTIFYALRYHHIMTARRSGAIIAGIWAFCTGCGIVFILYSESTYVILCLISMFFAMLFLLVSLYIHMFLLARTHVKRIAALPGASSARQRTSMQGAVTVTMLLGVFTVCWAPFFLHLTLMLSCPQNLYCSRFMSHFNMYLILIMCNSVMDPLIYAFRSQEMRKTFKEIICCRGFRIACSFPRRD

SEQ ID NO: 1082 - protein, 350 aa, homo sapiens [sequence omitted]

SEQ ID NO: 1083 - protein, 362 aa, homo sapiens
MSENGSFANCCEAGGWAVRPGWSGAGSARPSRTPRPPWVAPALSAVLIVTTAVDVVGNLLVILSVLRNRKLRNAGNLFLVSLALADLVVAFYPYPLILVAIFYDGWALGEEHCKASAFVMGLSVIGSVFNITAIAINRYCYICHSMAYHRIYRRWHTPLHICLIWLLTVVALLPNFFVGSLEYDPRIYSCTFIQTASTQYTAAVVVIHFLLPIAVVSFCYLRIWVLVLQARRKAKPESRLCLKPSDLRSFLTMFVVFVIFAICWAPLNCIGLAVAINPQEMAPQIPEGLFVTSYLLAYFNSCLNAIVYGLLNQNFRREYKRILLALWNPRHCIQDASKGSHAEGLQSPAPPIIGVQHQADAL

SEQ ID NO: 1084 - protein, 415 aa, homo sapiens
MVFAHRMDNSKPHLIIPTLLVPLQNRSCTETATPLPSQYLMELSEEHSWMSNQTDLHYVLKPGEVATASIFFGILWLFSIFGNSLVCLVIHRSRRTQSTTNYFVVSMACADLLISVASTPFVLLQFTTGRWTLGSATCKVVRYFQYLTPGVQIYVLLSICIDRFYTIVYPLSFKVSREKAKKMIAASWIFDAGFVTPVLFFYGSNWDSHCNYFLPSSWEGTAYTVIHFLVGFVIPSVLIILFYQKVIKYIWRIGTDGRTVRRTMNIVPRTKVKTIKMFLILNLLFLLSWLPFHVAQLWHPHEQDYKKSSLVFTAITWISFSSSASKPTLYSIYNANFRRGMKETFCMSSMKCYRSNAYTITTSSRMAKKNYVGISEIPSMAKTITKDSIYDSFDREAKEKKLAWPINSNPPNTFV

SEQ ID NO: 1085 - protein, 445 aa, homo sapiens
MDLELDEYYNKTLATENNTAATRNSDFPVWDDYKSSVDDLQYFLIGLYTFVSLLGFMGNLLILMALMKKRNQKTTVNFLIGNLAFSDILVVLFCSPFTLTSVLLDQWMFGKVMCHIMPFLQCVSVLVSTLILISIAIVRYHMIKHPISNNLTANHGYFLIATVWTLGFAICSPLPVFHSLVELQETFGSALLSSRYLCVESWPSDSYRIAFTISLLLVQYILPLVCLTVSHTSVCRSISCGLSNKENRLEENEMINLTLHPSKKSGPQVKLSGSHKWSYSFIKKHRRRYSKKTACVLPAPERPSQENHSRILPENFGSVRSQLSSSSKFIPGVPTCFEIKPEENSDVHELRVKRSVTRIKKRSRSVFYRLTILILVFAVSWMPLHLFHVVTDFNDNLISNRHFKLVYCICHLLGMMSCCLNPILYGFLNNGIKADLVSLIHCLHM

SEQ ID NO: 1086 - protein, 337 aa, homo sapiens
MDETGNLTVSSATCHDTIDDFRNQVYSTLYSMISVVGFFGNGFVLYVLIKTYHKKSAFQVYMINLAVADLLCVCTLPLRVVYYVHKGIWLFGDFLCRLSTYALYVNLYCSIFFMTAMSFFRCIAIVFPVQNINLVTQKKARFVCVGIWIFVILTSSPFLMAKPQKDEKNNTKCFEPPQDNQTKNHVLVLHYVSLFVGFIIPFVIIIVCYTMIILTLLKKSMKKNLSSHKKAIGMIMVVTAAFLVSFMPYHIQRTIHLHFLHNETKPCDSVLRMQKSVVITLSLAASNCCFDPLLYFFSGGNFRKRLSTFRKHSLSSVTYVPRKKASLPEKGEEICKV

SEQ ID NO: 1087 - protein, 342 aa, homo sapiens
MAEHDYHEDYGFSSFNDSSQEEHQDFLQFSKVFLPCMYLVVFVCGLVGNSLVLVISIFYHKLQSLTDVFLVNLPLADLVFVCTLPFWAYAGIHEWVFGQVMCKSLLGIYTINFYTSMLILTCITVDRFIVVVKATKAYNQQAKRMTWGKVTSLLIWVISLLVSLPQIIYGNVFNLDKLICGYHDEAISTVVLATQMTLGFFLPLLTMIVCYSVIIKTLLHAGGFQKHRSLKIIFLVMAVFLLTQMPFNLMKFIRSTHWEYYAMTSFHYTIMVTEAIAYLRACLNPVLYAFVSLKFRKNFWKLVKDIGCLPYLGVSHQWKSSEDNSKTFSASHNVEATSMFQL

SEQ ID NO: 1088 - protein, 540 aa, homo sapiens
MNSTGHLQDAPNATSLHVPHSQEGNSTSLQEGLQDLIHTATLVTCTFLLAVIFCLGSYGNFIVFLSFFDPAFRKFRTNFDFMILNLSFCDLFICGVTAPMFTFVLFFSSASSIPDAFCFTFHLTSSGFIIMSLKTVAVIALHRLRMVLGKQPNRTASFPCTVLLTLLLWATSFTLATLATLKTSKSHLCLPMSSLIAGKGKAILSLYVVDFTFCVAVVSVSYIMIAQTLRKNAQVRKCPPVITVDASRPQPFMGVPVQGGGDPIQCAMPALYRNQNYNKLQHVQTRGYTKSPNQLVTPAASRLQLVSAINLSTAKDSKAVVTCVIIVLSVLVCCLPLGISLVQVVLSSNGSFILYQFELFGFTLIFFKSGLNPFIYSRNSAGLRRKVLWCLQYIGLGFFCCKQKTRLRAMGKGNLEVNRNKSSHHETNSAYMLSPKPQKKFVDQACGPSHSKESMVSPKISAGHQHCGQSSSTPINTRIEPYYSIYNSSPSQEESSPCNLQPVNSFGFANSYIAMHYHTTNDLVQEYDSTSAKQIPVPSV

SEQ ID NO: 1089 - protein, 412 aa, homo sapiens
MPIMGSSVYITVELAIAVLAILGNVLVCWAVWLNSNLQNVTNYFVVSLAAADIAVGVLAIPFAITISTGFCAACHGCLFIACFVLVLTQSSIFSLLAIAIDRYIAIRIPLRYNGLVTGTRAKGIIAICWVLSFAIGLTPMLGWNNCGQPKEGKNHSQGCGEGQVACLFEDVVPMNYMVYFNFFACVLVPLLLMLGVYLRIFLAARRQLKQMESQPLPGERARSTLQKEVHAAKSLAIIVGLFALCWLPLHIINCFTFFCPDCSHAPLWLMYLAIVLSHTNSVVNPFIYAYRIREFRQTFRKIIRSHVLRQQEPFKAAGTSARVLAAHGSDGEQVSLRLNGHPPGVWANGSAPHPERRPNGYALGLVSGGSAQESQGNTGLPDVELLSHELKGVCPEPPGLDDPLAQDGAGVS

SEQ ID NO: 1090 - protein, 404 aa, homo sapiens
MSVKPSWGPGPSEGVTAVPTSDLGEIHNWTELLDLFNHTLSECHVELSQSTKRVVLFALYLAMFVVGLVENLLVICVNWRGSGRAGLMNLYILNMAIADLGIVLSLPVWMLEVTLDYTWLWGSFSCRFTHYFYFVNMYSSIFFLVCLSVDRYVTLTSASPSWQRYQHRVRRAMCAGIWVLSAIIPLPEVVHIQLVEGPEPMCLFMAPFETYSTWALAVALSTTILGFLLPFPLITVFNVLTACRLRQPGQPKSRRHCLLLCAYVAVFVMCWLPYHVTLLLLTLHGTHISLHCHLVHLLYFFYDVIDCFSMLHCVINPILYNFLSPHFRGRLLNAVVHYLPKDQTKAGTCASSSSCSTQHSIIITKGDSQPAAAAPHPEPSLSFQAHHLLPNTSPISPTQPLTPS

SEQ ID NO: 1091 - protein, 833 aa, Saccharomyces cerevisiae
MITLLLYLCVICNAIVLIRADSIADPWPEARHLLNTIAKSRDPMKEAAMEPNADEFVGFYVPMDYSPRNEEKNYQSIWQNEITDSQRHIYELLVQSSEQFNNSEATYTLSQIHLWSQYNFPHNMTLAHKYLEKFNDLTHFTNHSAIFDLAVMYATGGCASGNDQTVIPQDSAKALLYYQRAAQLGNLKAKQVLAYKYYSGFNVPRNFHKSLVLYRDIAEQLRKSYSRDEWDIVFPYWESYNVRISDFESGLLGKGLNSVPSSTVRKRTTRPDIGSPFIAQVNGVQMTLQIEPMGRFAFNGNDGNINGDEDDEDASERRIIRIYYAALNDYKGTYSQSRNCERAKNLLELTYKEFQPHVDNLDPLQVFYYVRCLQLLGHMYFTGEGSSKPNIHMAEEILTTSLEISRRAQGPIGRACIDLGLINQYITNNISQAISYYMKAMKTQANNGIVEFQLSKLATSFPEEKIGDPFNLMETAYLNGFIPAIYEFAVMIESGMNSKSSVENTAYLFKTFVDKNEAIMAPKLRTAFAALINDRSEVALWAYSQLAEQGYETAQVSAAYLMYQLPYEFEDPPRTTDQRKTLAISYYTRAFKQGNIDAGVVAGDIYFQMQNYSKAMALYQGAALKYSIQAIWNLGYMHEHGLGVNRDFHLAKRYYDQVSEHDHRFYLASKLSVLKLHLKSWLTWITREKVNYWKPSSPLNPNEDTQHSKTSWYKQLTKILQRMRHKEDSDKAAEDSHKHRTVVQNGANHRGDDQEEASEILGFQMEDLVTMGCILGIFLLSILMSTLAARRGWNVRFNGAQLNANGNRQQEQQQQQQAQGPPGWDFNVQIFAI

SEQ ID NO: 1092 - protein, 353 aa, homo sapiens
MNECHYDKHMDFFYNRSNTDTVDDWTGTKLVIVLCVGTFFCLFIFFSNSLVIAAVIKNRKFHFPFYYLLANLAAADFFAGIAYVFLMFNTGPVSKTLTVNRWFLRQGLLDSSLTASLTNLLVIAVERHMSIMRMRVHSNLTKKRVTLLILLVWAIAIFMGAVPTLGWNCLCNISACSSLAPIYSRSYLVFWTVSNLMAFLIMVVVYLRIYVYVKRKTNVLSPHTSGSISRRRTPMKLMKTVMTVLGAFVVCWTPGLVVLLLDGLNCRQCGVQHVKRWFLLLALLNSVVNPIIYSYKDEDMYGTMKKMICCFSQENPERRPSRIPSTVLSRSDTGSQYIEDSISQGAVCNKSTS

SEQ ID NO: 1093 - protein, 1403 aa, homo sapiens
MVSSGCRMRSLWFIIVISFLPNTEGFSRAALPFGLVRRELSCEGYSIDLRCPGSDVIMIESANYGRTDDKICDADPFQMENTDCYLPDAFKIMTQRCNNRTQCIVVTGSDVFPDPCPGTYKYLEVQYECVPYIFVCPGTLKAIVDSPCIYEAEQKAGAWCKDPLQAADKIYFMPWTPYRTDTLIEYASLEDFQNSRQTTTYKLPNRVDGTGFVVYDGAVFFNKERTRNIVKFDLRTRIKSGEAIINYANYHDTSPYRWGGKTDIDLAVDENGLWVIYATEQNNGMIVISQLNPYTLRFEATWETVYDKRAASNAFMICGVLYVVRSVYQDNESETGKNSIDYIYNTRLNRGEYVDVPFPNQYQYIAAVDYNPRDNQLYVWNNNFILRYSLEFGPPDPAQVPTTAVTITSSAELFKTIISTTSTTSQKGPMSTTVAGSQEGSKGTKPPPAVSTTKIPPITNIFPLPERFCEALDSKGIKWPQTQRGMMVERPCPKGTRGTASYLCMISTGTWNPKGPDLSNCTSHWVNQLAQKIRSGENAASLANELAKHTKGPVFAGDVSSSVRLMEQLVDILDAQLQELKPSEKDSAGRSYNKAIVDTVDNLLRPEALESWKHMNSSEQAHTATMLLDTLEEGAFVLADNLLEPTRVSMPTENIVLEVAVLSTEGQIQDFKFPLGIKGAGSSIQLSANTVKQNSRNGLAKLVFIIYRSLGQFLSTENATIKLGADFIGRNSTIAVNSHVISVSINKESSRVYLTDPVLFTLPHIDPDNYFNANCSFWNYSERTMMGYWSTQGCKLVDTNKTRTTCACSHLTNFAILMAHREIAYKDGVHELLLTVITWVGIVISLVCLAICIFTFCFFRGLQSDRNTIHKNLCINLFIAEFIFLIGIDKTKYAIACPIFAGLLHFFFLAAFAWMCLEGVQLYLMLVEVFESEYSRKKYYYVAGYLFPATVVGVSAAIDYKSYGTEKACWLHVDNYFIWSFIGPVTFIILLNIIFLVITLCKMVKHSNTLKPDSSRLENIKSWVLGAFALLCLLGLTWSFGLLFINEETIVMAYLFTIFNAFQGVFIFIFHCALQKKVRKEYGKCFRHSYCCGGLPTESPHSSVKASTTRTSARYSSGTQSRIRRMWNDTVRKQSESSFISGDINSTSTLNQGHSLNNARDTSAMDTLPLNGNFNNSYSLHKGDYNDSVQVVDCGLSLNDTAFEKMIISELVHNNLRGSSKTHNLELTLPVKPVIGGSSSEDDAIVADASSLMHSDNPGLELHHKELEAPLIPQRTHSLLYQPQKKVKSEGTDSYVSQLTAEAEDHLQSPNRDSLYTSMPNLRDSPYPESSPDMEEDLSPSRRSENEDIYYKSMPNLGAGHQLQMCYQISRGNSDGYIIPINKEGCIPEGDVREGQMQLVTSL

SEQ ID NO: 1094 - protein, 410 aa, homo sapiens
METSSPRPPRPSSNPGLSLDARLGVDTRLWAKVLFTALYALIWALGAAGNALSVHVVLKARAGRAGRLRHHVLSLALAGLLLLLVGVPVELYSFVWFHYPWVFGDLGCRGYYFVHELCAYATVLSVAGLSAERCLAVCQPLRARSLLTPRRTRWLVALSWAASLGLALPMAVIMGQKHELETADGEPEPASRVCTVLVSRTALQVFIQVNVLVSFVLPLALTAFLNGVTVSHLLALCSQVPSTSTPGSSTPSRLELLSEEGLLSFIVWKKTFIQGGQVSLVRHKDVRRIRSLQRSVQVLRAIVVMYVICWLPYHARRLMYCYVPDDAWTDPLYNFYHYFYMVTNTLFYVSSAVTPLLYNAVSSSFRKLFLEAVSSLCGEHHPMKRLPPKPQSPTLMDTASGFGDPPETRT

SEQ ID NO: 1095 - protein, 380 aa, homo sapiens
MCPMLLKNGYNGNATPVTTTAPWASLGLSAKTCNNVSFEESRIVLVVVYSAVCTLGVPANCLTAWLALLQVLQGNVLAVYLLCLALCELLYTGTLPLWVIYIRNQHRWTLGLLACKVTAYIFFCNIYVSILFLCCISCDRFVAVVYALESRGRRRRRTAILISACIFILVGIVHYPVFQTEDKETCFDMLQMDSRIAGYYYARFTVGFAIPLSIIAFTNHRIFRSIKQSMGLSAAQKAKVKHSAIAVVVIFLVCFAPYHLVLLVKAAAFSYYRGDRNAMCGLEERLYTASVVFLCLSTVNGVADPIIYVLATDHSRQEVSRIHKGWKEWSMKTDVTRLTHSRDTEELQSPVALADHYTFSRPVHPPGSPCPAKRLIEESC

SEQ ID NO: 1096 - protein, 532 aa, homo sapiens
MEGDSYHNATTVNGTPVNHQPLERHRLWEVITIAAVTAVVSLITIVGNVLVMISFKVNSQLKTVNNYYLLSLACADLIIGIFSMNLYTTYILMGRWALGSLACDLWLALDYVASNASVMNLLVISFDRYFSITRPLTYRAKRTPKRAGIMIGLAWLISFILWAPAILCWQYLVGKRTVPLDECQIQFLSEPTITFGTAIAAFYIPVSVMTILYCRIYRETEKRTKDLADLQGSDSVTKAEKRKPAHRALFRSCLRCPRPTLAQRERNQASWSSSRRSTSTTGKPSQATGPSANWAKAEQLTTCSSYPSSEDEDKPATDPVLQVVYKSQGKESPGEEFSAEETEETFVKAETEKSDYDTPNYLLSPAAAHRPKSQKCVAYKFRLVVKADGNQETNNGCHKVKIMPCPFPVAKEPSTKGLNPNPSHQMTKRKRVVLVKERKAAQTLSAILLAFIITWTPYNIMVLVSTFCDKCVPVTLWHLGYWLCYVNSTVNPICYALCNRTFRKTFKMLLLCRWKKKKVEEKLYWQGNSKLP

SEQ ID NO: 1097 - protein, 351 aa, homo sapiens
MVIMGQCYYNETIGFFYNNSGKELSSHWRPKDVVVVALGLTVSVLVLLTNLLVIAAIASNRRFHQPIYYLLGNLAAADLFAGVAYLFLMFHTGPRTARLSLEGWFLRQGLLDTSLTASVATLLAIAVERHRSVMAVQLHSRLPRGRVVMLIVGVWVAALGLGLLPAHSWHCLCALDRCSRMAPLLSRSYLAVWALSSLLVFLLMVAVYTRIFFYVRRRVQRMAEHVSCHPRYRETTLSLVKTVVIILGAFVVCWTPGQVVLLLDGLGCESCNVLAVEKYFLLLAEANSLVNAAVYSCRDAEMRRTFRRLLCCACLRQSTRESVHYTSSAQGGASTRIMLPENGHPLMDSTL

SEQ ID NO: 1098 - protein, 338 aa, homo sapiens
MTALSSENCSFQYQLRQTNQPLDVNYLLFLIILGKILLNILTLGMRRKNTCQNFMEYFCISLAFVDLLLLVNISIILYFRDFVLLSIRFTKYHICLFTQIISFTYGFLHYPVFLTACIDYCLNFSKTTKLSFKCQKLFYFFTVILIWISVLAYVLGDPAIYQSLKAQNAYSRHCPFYVSIQSYWLSFFMVMILFVAFITCWEEVTTLVQAIRITSYMNETILYFPFSSHSSYTVRSKKIFLSKLIVCFLSTWLPFVLLQVIIVLLKVQIPAYIEMNIPWLYFVNSFLIATVYWFNCHKLNLKDIGLPLDPFVNWKCCFIPLTIPNLEQIEKPISIMIC

SEQ ID NO: 1099 - protein, 465 aa, homo sapiens
MATLPAAETWIDGGGGVGADAVNLTASLAAGAATGAVETGWLQLLDQAGNLSSSPSALGLPVASPAPSQPWANLTNQFVQPSWRIALWSLAYGVVVAVAVLGNLIVIWIILAHKRMRTVTNYFLVNLAFSDASMAAFNTLVNFIYALHSEWYFGANYCRFQNFFPITAVFASIYSMTAIAVDRYMAIIDPLKPRLSATATKIVIGSIWILAFLLAFPQCLYSKTKVMPGRTLCFVQWPEGPKQHFTYHIIVIILVYCFPLLIMGITYTIVGITLWGGEIPGDTCDKYHEQLKAKRKVVKMMIIVVMTFAICWLPYHIYFILTAIYQQLNRWKYIQQVYLASFWLAMSSTMYNPIIYCCLNKRFRAGFKRAFRWCPFIKVSSYDELELKTTRFHPNRQSSMYTVTRMESMTVVFDPNDADTTRSSRKKRATPRDPSFNGCSRRNSKSASATSSFISSPYTSVDEYS

SEQ ID NO: 1100 - protein, 469 aa, homo sapiens
MQMADAATIATMNKAAGGDKLAELFSLVPDLLEAANTSGNASLQLPDLWWELGLELPDGAPPGHPPGSGGAESADTEARVRILISVVYWVVCALGLAGNLLVLYLMKSMQGWRKSSINLFVTNLALTDFQFVLTLPFWAVENALDFKWPFGKAMCKIVSMVTSMNMYASVFFLTAMSVTRYHSVASALKSHRTRGHGRGDCCGRSLGDSCCFSAKALCVWIWALAALASLPSAIFSTTVKVMGEELCLVRFPDKLLGRDRQFWLGLYHSQKVLLGFVLPLGIIILCYLLLVRFIADRRAAGTKGGAAVAGGRPTGASARRLSKVTKSVTIVVLSFFLCWLPNQALTTWSILIKFNAVPFSQEYFLCQVYAFPVSVCLAHSNSCLNPVLYCLVRREFRKALKSLLWRIASPSITSMRPFTATTKPEHEDQGLQAPAPPHAAAEPDLLYYPPGVVVYSGGRYDLLPSSSAY

SEQ ID NO: 1101 - protein, 403 aa, homo sapiens
MFVASERKMRAHQVLTFLLLFVITSVASENASTSRGCGLDLLPQYVSLCDLDAIWGIVVEAVAGAGALITLLLMLILLVRLPFIKEKEKKSPVGLHFLFLLGTLGLFGLTFAFIIQEDETICSVRRFLWGVLFALCFSCLLSQAWRVRRLVRHGTGPAGWQLVGLALCLMLVQVIIAVEWLVLTVLRDTRPACAYEPMDFVMALIYDMVLLVVTLGLALFTLCGKFKRWKLNGAFLLITAFLSVLIWVAWMTMYLFGNVKLQQGDAWNDPTLAITLAASGWVFVIFHAIPEIHCTLLPALQENTPNYFDTSQPRMRETAFEEDVQLPRAYMENKAFSMDEHNAALRTAGFPNGSLGKRPSGSLGKRPSAPFRSNVYQPTEMAVVLNGGTIPTAPPSHTGRHLW

SEQ ID NO: 1102 - protein, 345 aa, homo sapiens
MYKDCIESTGDYFLLCDAEGPWGIILESLAILGIVVTILLLLAFLFLMRKIQDCSQWNVLPTQLLFLLSVLGLFGLAFAFIIELNQQTAPVRYFLFGVLFALCFSCLLAHASNLVKLVRGCVSFSWTTILCIAIGCSLLQIIIATEYVTLIMTRGMMFVNMTPCQLNVDFVVLLVYVLFLMALTFFVSKATFCGPCENWKQHGRLIFITVLFSIIIWVVWISMLLRGNPQFQRQPQWDDPVVCIALVTNAWVFLLLYIVPELCILYRSCRQECPLQGNACPVTAYQHSFQVENQELSRARDSDGAEEDVALTSYGTPIQPQTVDPTQECFIPQAKLSPQQDAGGV

SEQ ID NO: 1103 - protein, 337 aa, homo sapiens [sequence omitted]

SEQ ID NO: 1104 - protein, 389 aa, homo sapiens
MALTPESPSSFPGLAATGSSVPEPPGGPNATLNSSWASPTEPSSLEDLVATGTIGTLLSAMGVVGVVGNAYTLVVTCRSLRAVASMYVYVVNLALADLLYLLSIPFIVATYVTKEWHFGDVGCRVLFGLDFLTMHASIFTLTVMSSERYAAVLRPLDTVQRPKGYRKLLALGTWLLALLLTLPVMLAMRLVRRGPKSLCLPAWGPRAHRAYLTLLFATSIAGPGLLIGLLYARLARAYRRSQRASFKRARRPGARALRLVLGIVLLFWACFLPFWLWQLLAQYHQAPLAPRTARIVNYLTTCLTYGNSCANPFLYTLLTRNYRDHLRGRVRGPGSGGGRGPVPSLQPRARFQRCSGRSLSSCSPQPTDSLVLAPAAPARPAPEGPRAPA

SEQ ID NO: 1105 - protein, 375 aa, homo sapiens
MANASEPGGSGGGEAAALGLKLATLSLLLCVSLAGNVLFALLIVRERSLHRAPYYLLLDLCLADGLRALACLPAVMLAARRAAAAAGAPPGALGCKLLAFLAALFCFHAAFLLLGVGVTRYLAIAHHRFYAERLAGWPCAAMLVCAAWALALAAAFPPVLDGGGDDEDAPCALEQRPDGAPGALGFLLLLAVVVGATHLVYLRLLFFIHDRRKMRPARLVPAVSHDWTFHGPGATGQAAANWTAGFGRGPTPPALVGIRPAGPGRGARRLLVLEEFKTEKRLCKMFYAVTLLFLLLWGPYVVASYLRVLVRPGAVPQAYLTASVWLTFAQAGINPVVCFLFNRELRDCFRAQFPCCQSPRTTQATHPCDLKGIGL

SEQ ID NO: 1106 - protein, 373 aa, homo sapiens
MANTTGEPEEVSGALSPPSASAYVKLVLLGLIMCVSLAGNAILSLLVLKERALHKAPYYFLLDLCLADGIRSAVCFPFVLASVRHGSSWTFSALSCKIVAFMAVLFCFHAAFMLFCISVTRYMAIAHHRFYAKRMTLWTCAAVICMAWTLSVAMAFPPVFDVGTYKFIREEDQCIFEHRYFKANDTLGFMLMLAVLMAATHAVYGKLLLFEYRHRKMKPVQMVPAISQNWTFHGPGATGQAAANWIAGFGRGPMPPTLLGIRQNGHAASRRLLGMDEVKGEKQLGRMFYAITLLFLLLWSPYIVACYWRVFVKACAVPHRYLATAVWMSFAQAAVNPIVCFLLNKDLKKCLRTHAPCWGTGGAPAPREPYCVM

SEQ ID NO: 1107 - protein, 168 aa, Autographa californica nucleopolyhedrovirus
MFPARWHNYLQCGQVIKDSNLICFKTPLRPELFAYVTSEEDVWTAEQIVKQNPSIGAIIDLTNTSKYYDGVHFLRAGLLYKKIQVPGQTLPPESIVQEFIDTVKEFTEKCPGMLVGVHCTHGINRTGYMVCRYLMHTLGIAPQEAIDRFEKARGHKIERQNYVQDLLI

SEQ ID NO: 1108 - protein, 588 aa, homo sapiens
MARGGAGAEEASLRSNALSWLACGLLALLANAWIILSISAKQQKHKPLELLLCFLAGTHILMAAVPLTTFAVVQLRRQASSDYDWNESICKVFVSTYYTLALATCFTVASLSYHRMWMVRWPVNYRLSNAKKQALHAVMGIWMVSFILSTLPSIGWHNNGERYYARGCQFIVSKIGLGFGVCFSLLLLGGIVMGLVCVAITFYQTLWARPRRARQARRVGGGGGTKAGGPGALGTRPAFEVPAIVVEDARGKRRSSLDGSESAKTSLQVTNLVSAIVFLYDSLTGVPILVVSFFSLKSDSAPPWMVLAVLWCSMAQTLLLPSFIWSCERYRADVRTVWEQCVAIMSEEDGDDDGGCDDYAEGRVCKVRFDANGATGPGSRDPAQVKLLPGRHMLFPPLERVHYLQVPLSRRLSHDETNIFSTPREPGSFLHKWSSSDDIRVLPAQSRALGGPPEYLGQRHRLEDEEDEEEAEGGGLASLRQFLESGVLGSGGGPPRGPGFFREEITTFIDETPLPSPTASPGHSPRRPRPLGLSPRRLSLGSPESRAVGLPLGLSAGRRCSLTGGEESARAWGGSWGPGNPIFPQLTL

SEQ ID NO: 1109 - protein, 396 aa, homo sapiens
MWNSSDANFSCYHESVLGYRYVAVSWGVVVAVTGTVGNVLTLLALAIQPKLRTRFNLLIANLTLADLLYCTLLQPFSVDTYLHLHWRTGATFCRVFGLLLFASNSVSILTLCLIALGRYLLIAHPKLFPQVFSAKGIVLALVSTWVVGVASFAPLWPIYILVPVVCTCSFDRIRGRPYTTILMGIYFVLGLSSVGIFYCLIHRQVKRAAQALDQYKLRQASIHSNHVARTDEAMPGRFQELDSRLASGGPSEGISSEPVSAATTQTLEGDSSEVGDQINSKRAKQMAEKSPPEASAKAQPIKGARRAPDSSSEFGKVTRMCFAVFLCFALSYIPFLLLNILDARVQAPRVVHMLAANLTWLNGCINPVLYAAMNRQFRQAYGSILKRGPRSFHRLH

SEQ ID NO: 1110 - protein, 346 aa, homo sapiens
MERKFMSLQPSISVSEMEPNGTFSNNNSRNCTIENFKREFFPIVYLIIFFWGVLGNGLSIYVFLQPYKKSTSVNVFMLNLAISDLLFISTLPFRADYYLRGSNWIFGDLACRIMSYSLYVNMYSSIYFLTVLSVVRFLAMVHPFRLLHVTSIRSAWILCGIIWILIMASSIMLLDSGSEQNGSVTSCLELNLYKIAKLQTMNYIALVVGCLLPFFTLSICYLLIIRVLLKVEVPESGLRVSHRKALTTIIITLIIFFLCFLPYHTLRTVHLTTWKVGLCKDRLHKALVITLALAAANACFNPLLYYFAGENFKDRLKSALRKGHPQKAKTKCVFPVSVWLRKETRV

SEQ ID NO: 1111 - protein, 372 aa, homo sapiens [sequence omitted]

SEQ ID NO: 1112 - protein, 339 aa, homo sapiens
MANLDKYTETFKMGSNSTSTAEIYCNVTNVKFQYSLYATTYILIFIPGLLANSAALWVLCRFISKKNKAIIFMINLSVADLAHVLSLPLRIYYYISHHWPFQRALCLLCFYLKYLNMYASICFLTCISLQRCFFLLKPFRARDWKRRYDVGISAAIWIVVGTACLPFPILRSTDLNNNKSCFADLGYKQMNAVALVGMITVAELAGFVIPVIIIAWCTWKTTISLRQPPMAFQGISERQKALRMVFMCAAVFFICFTPYHINFIFYTMVKETIISSCPVVRIALYFHPFCLCLASLCCLLDPILYYFMASEFRDQLSRHGSSVTRSRLMSKESGSSMIG

SEQ ID NO: 1113 - protein, 961 aa, homo sapiens
MLLLLLLAPLFLRPPGAGGAQTPNATSEGCQIIHPPWEGGIRYRGLTRDQVKAINFLPVDYEIEYVCRGEREVVGPKVRKCLANGSWTDMDTPSRCVRICSKSYLTLENGKVFLTGGDLPALDGARVDFRCDPDFHLVGSSRSICSQGQWSTPKPHCQVNRTPHSERRAVYIGALFPMSGGWPGGQACQPAVEMALEDVNSRRDILPDYELKLIHHDSKCDPGQATKYLYELLYNDPIKIILMPGCSSVSTLVAEAARMWNLIVLSYGSSSPALSNRQRFPTFFRTHPSATLHNPTRVKLFEKWGWKKIATIQQTTEVFTSTLDDLEERVKEAGIEITFRQSFFSDPAVPVKNLKRQDARIIVGLFYETEARKVFCEVYKERLFGKKYVWFLIGWYADNWFKIYDPSINCTVDEMTEAVEGHITTEIVMLNPANTRSISNMTSQEFVEKLTKRLKRHPEETGGFQEAPLAYDAIWALALALNKTSGGGGRSGVRLEDFNYNNQTITDQIYRAMNSSSFEGVSGHVVFDASGSRMAWTLIEQLQGGSYKKIGYYDSTKDDLSWSKTDKWIGGSPPADQTLVIKTFRFLSQKLFISVSVLSSLGIVLAVVCLSFNIYNSHVRYIQNSQPNLNNLTAVGCSLALAAVFPLGLDGYHIGRNQFPFVCQARLWLLGLGFSLGYGSMFTKIWWVHTVFTKKEEKKEWRKTLEPWKLYATVGLLVGMDVLTLAIWQIVDPLHRTIETFAKEEPKEDIDVSILPQLEHCSSRKMNTWLGIFYGYKGLLLLLGIFLAYETKSVSTEKINDHRAVGMAIYNVAVLCLITAPVTMILSSQQDAAFAFASLAIVFSSYITLVVLFVPKMRRLITRGEWQSEAQDTMKTGSSTNNNEEEKSRLLEKENRELEKIIAEKEERVSELRHQLQSRQQLRSRRHPPTPPEPSGGLPRGPPEPPDRLSCDGSRVHLLYK

SEQ ID NO: 1114 - protein, 471 aa, homo sapiens
MDILCEENTSLSSTTNSLMQLNDDTRLYSNDFNSGEANTSDAFNWTVDSENRTNLSCEGCLSPSCLSLLHLQEKNWSALLTAVVIILTIAGNILVIMAVSLEKKLQNATNYFLMSLAIADMLLGFLVMPVSMLTILYGYRWPLPSKLCAVWIYLDVLFSTASIMHLCAISLDRYVAIQNPIHHSRFNSRTKAFLKIIAVWTISVGISMPIPVFGLQDDSKVFKEGSCLLADDNFVLIGSFVSFFIPLTIMVITYFLTIKSLQKEATLCVSDLGTRAKLASFSFLPQSSLSSEKLFQRSIHREPGSYTGRRTMQSISNEQKACKVLGIVFFLFVVMWCPFFITNIMAVICKESCNEDVIGALLNVFVWIGYLSSAVNPLVYTLFNKTYRSAFSRYIQCQYKENKKPLQLILVNTIPALAYKSSQLQMGQKKNSKQDAKTTDNDCSMVALGKQHSEEASKDNSDGVNEKVSCV

SEQ ID NO: 1115 - protein, 366 aa, homo sapiens
MDFLNSSDQNLTSEELLNRMPSKILVSLTLSGLALMTTTINSLVIAAIIVTRKLHHPANYLICSLAVTDFLVAVLVMPFSIVYIVRESWIMGQVVCDIWLSVDITCCTCSILHLSAIALDRYRAITDAVEYARKRTPKHAGIMITIVWIISVFISMPPLFWRHQGTSRDDECIIKHDHIVSTIYSTFGAFYIPLALILILYYKIYRAAKTLYHKRQASRIAKEEVNGQVLLESGEKSTKSVSTSYVLEKSLSDPSTDFDKIHSTVRSLRSEFKHEKSWRRQKISGTRERKAATTLGLILGAFVICWLPFFVKELVVNVCDKCKISEEMSNFLAWLGYLNSLINPLIYTIFNEDFKKAFQKLVRCRC

SEQ ID NO: 1116 - protein, 388 aa, homo sapiens
MDKLDANVSSEEGFGSVEKVVLLTFLSTVILMAILGNLLVMVAVCWDRQLRKIKTNYFIVSLAFADLLVSVLVMPFGAIELVQDIWIYGEVFCLVRTSLDVLLTTASIFHLCCISLDRYYAICCQPLVYRNKMTPLRIALMLGGCWVIPTFISFLPIMQGWNNIGIIDLIEKRKFNQNSNSTYCVFMVNKPYAITCSVVAFYIPFLLMVLAYYRIYVTAKEHAHQIQMLQRAGASSESRPQSADQHSTHRMRTETKAAKTLCIIMGCFCLCWAPFFVTNIVDPFIDYTVPGQVWTAFLWLGYINSGLNPFLYAFLNKSFRRAFLIILCCDDERYRRPSILGQTVPCSTTTINGSTHVLRDAVECGGQWESQCHPPATSPLVAAQPSDT

SEQ ID NO: 1117 - protein, 430 aa, homo sapiens
MEGEPSQPPNSSWPLSQNGTNTEATPATNLTFSSYYQHTSPVAAMFIVAYALIFLLCMVGNTLVCFIVLKNRHMHTVTNMFILNLAVSDLLVGIFCMPTTLVDNLITGWPFDNATCKMSGLVQGMSVSASVFTLVAIAVERFRCIVHPFREKLTLRKALVTIAVIWALALLIMCPSAVTLTVTREEHHFMVDARNRSYPLYSCWEAWPEKGMRRVYTTVLFSHIYLAPLALIVVMYARIARKLCQAPGPAPGGEEAADPRASRRRARVVHMLVMVALFFTLSWLPLWALLLLIDYGQLSAPQLHLVTVYAFPFAHWLAFFNSSANPIIYGYFNENFRRGFQAAFRARLCPRPSGSHKEAYSERPGGLLHRRVFVVVRPSDSGLPSESGPSSGAPRPGRLPLRNGRVAHHGLPREGPGCSHLPLTIPAWDI

SEQ ID NO: 1118 - protein, 342 aa, homo sapiens
MQAVDNLTSAPGNTSLCTRDYKITQVLFPLLYTVLFFVGLITNGLAMRIFFQIRSKSNFIIFLKNTVISDLLMILTFPFKILSDAKLGTGPLRTFVCQVTSVIFYFTMYISISFLGLITIDRYQKTTRPFKTSNPKNLLGAKILSVVIWAFMFLLSLPNMILTNRQPRDKNVKKCSFLKSEFGLVWHEIVNYICQVIFWINFLIVIVCYTLITKELYRSYVRTRGVGKVPRKKVNVKVFIIIAVFFICFVPFHFARIPYTLSQTRDVFDCTAENTLFYVKESTLWLTSLNACLDPFIYFFLCKSFRNSLISMLKCPNSATSLSQDNRKKEQDGGDPNEETPM

SEQ ID NO: 1119 - protein, 382 aa, homo sapiens
MGPTSVPLVKAHRSSVSDYVNYDIIVRHYNYTGKLNISADKENSIKLTSVVFILICCFIILENIFVLLTIWKTKKFHRPMYYFIGNLALSDLLAGVAYTANLLLSGATTYKLTPAQWFLREGSMFVALSASVFSLLAIAIERYITMLKMKLHNGSNNFRLFLLISACWVISLILGGLPIMGWNCISALSSCSTVLPLYHKHYILFCTTVFTLLLLSIVILYCRIYSLVRTRSRRLTFRKNISKASRSSEKSLALLKTVIIVLSVFIACWAPLFILLLLDVGCKVKTCDILFRAEYFLVLAVLNSGTNPIIYTLTNKEMRRAFIRIMSCCKCPSGDSAGKFKRPIIAGMEFSRSKSDNSSHPQKDEGDNPETIMSSGNVNSSS

SEQ ID NO: 1120 - protein, 357 aa, homo sapiens
MDLPVNLTSFSLSTPSPLETNHSLGKDDLRPSSPLLSVFGVLILTLLGFLVAATFAWNLLVLATILRVRTFHRVPHNLVASMAVSDVLVAALVMPLSLVHELSGRRWQLGRRLCQLWIACDVLCCTASIWNVTAIALDRYWSITRHMEYTLRTRKCVSNVMIALTWALSAVISLAPLLFGWGETYSEGSEECQVSREPSYAVFSTVGAFYLPLCVVLFVYWKIYKAAKFRVGSRKTNSVSPISEAVEVKDSAKQPQMVFTVRHATVTFQPEGDTWREQKEQRAALMVGILIGVFVLCWIPFFLTELISPLCSCDIPAIWKSIFLWLGYSNSFFNPLIYTAFNKNYNSAFKNFFSRQH

SEQ ID NO: 1121 - protein, 2923 aa, homo sapiens
MRSPATGVPLPTPPPPLLLLLLLLLPPPLLGDQVGPCRSLGSRGRGSSGACAPMGWLCPSSASNLWLYTSRCRDAGTELTGHLVPHHDGLRVWCPESEAHIPLPPAPEGCPWSCRLLGIGGHLSPQGKLTLPEEHPCLKAPRLRCQSCKLAQAPGLRAGERSPEESLGGRRKRNVNTAPQFQPPSYQATVPENQPAGTPVASLRAIDPDEGEAGRLEYTMDALFDSRSNQFFSLDPVTGAVTTAEELDRETKSTHVFRVTAQDHGMPRRSALATLTILVTDTNDHDPVFEQQEYKESLRENLEVGYEVLTVRATDGDAPPNANILYRLLEGSGGSPSEVFEIDPRSGVIRTRGPVDREEVESYQLTVEASDQGRDPGPRSTTAAVFLSVEDDNDNAPQFSEKRYVVQVREDVTPGAPVLRVTASDRDKGSNAVVHYSIMSGNARGQFYLDAQTGALDVVSPLDYETTKEYTLRVRAQDGGRPPLSNVSGLVTVQVLDINDNAPIFVSTPFQATVLESVPLGYLVLHVQAIDADAGDNARLEYRLAGVGHDFPFTINNGTGWISVAAELDREEVDFYSFGVEARDHGTPALTASASVSVTVLDVNDNNPTFTQPEYTVRLNEDAAVGTSVVTVSAVDRDAHSVITYQITSGNTRNRFSITSQSGGGLVSLALPLDYKLERQYVLAVTASDGTRQDTAQIVVNVTDANTHRPVFQSSHYTVNVNEDRPAGTTVVLISATDEDTGENARITYFMEDSIPQFRIDADTGAVTTQAELDYEDQVSYTLAITARDNGIPQKSDTTYLEILVNDVNDNAPQFLRDSYQGSVYEDVPPFTSVLQISATDRDSGLNGRVFYTFQGGDDGDGDFIVESTSGIVRTLRRLDRENVAQYVLRAYAVDKGMPPARTPMEVTVTVLDVNDNPPVFEQDEFDVFVEENSPIGLAVARVTATDPDEGTNAQIMYQIVEGNIPEVFQLDIFSGELTALVDLDYEDRPEYVLVIQATSAPLVSRATVHVRLLDRNDNPPVLGNFEILFNNYVTNRSSSFPGGAIGRVPAHDPDISDSLTYSFERGNELSLVLLNASTGELKLSRALDNNRPLEAIMSVLVSDGVHSVTAQCALRVTIITDEMLTHSITLRLEDMSPERFLSPLLGLFIQAVAATLATPPDHVVVFNVQRDTDAPGGHILNVSLSVGQPPGPGGGPPFLPSEDLQERLYLNRSLLTAISAQRVLPFDDNICLREPCENYMRCVSVLRFDSSAPFIASSSVLFRPIHPVGGLRCRCPPGFTGDYCETEVDLCYSRPCGPHGRCRSREGGYTCLCRDGYTGEHCEVSARSGRCTPGVCKNGGTCVNLLVGGFKCDCPSGDFEKPYCQVTTRSFPAHSFITFRGLRQRFHFTLALSFATKERDGLLLYNGRFNEKHDFVALEVIQEQVQLTFSAGESTTTVSPFVPGGVSDGQWHTVQLKYYNKPLLGQTGLPQGPSEQKVAVVTVDGCDTGVALRFGSVLGNYSCAAQGTQGGSKKSLDLTGPLLLGGVPDLPESFPVRMRQFVGCMRNLQVDSRHIDMADFIANNGTVPGCPAKKNVCDSNTCHNGGTCVNQWDAFSCECPLGFGGKSCAQEMANPQHFLGSSLVAWHGLSLPISQPWYLSLMFRTRQADGVLLQAITRGRSTITLQLREGHVMLSVEGTGLQASSLRLEPGRANDGDWHHAQLALGASGGPGHAILSFDYGQQRAEGNLGPRLHGLHLSNITVGGIPGPAGGVARGFRGCLQGVRVSDTPEGVNSLDPSHGESINVEQGCSLPDPCDSNPCPANSYCSNDWDSYSCSCDPGYYGDNCTNVCDLNPCEHQSVCTRKPSAPHGYTCECPPNYLGPYCETRIDQPCPRGWWGHPTCGPCNCDVSKGFDPDCNKTSGECHCKENHYRPPGSPTCLLCDCYPTGSLSRVCDPEDGQCPCKPGVIGRQCDRCDNPFAEVTTNGCEVNYDSCPRAIEAGIWWPRTRFGLPAAAPCPKGSFGTAVRHCDEHRGWLPPNLFNCTSITFSELKGFAERLQRNESGLDSGRSQQLALLLRNATQHTAGYFGSDVKVAYQLATRLLAHESTQRGFGLSATQDVHFTENLLRVGSALLDTANKRHWELIQQTEGGTAWLLQHYEAYASALAQNMRHTYLSPFTIVTPNIVISVVRLDKGNFAGAKLPRYEALRGEQPPDLETTVILPESVFRETPPVVRPAGPGEAQEPEELARRQRRHPELSQGEAVASVIIYRTLAGLLPHNYDPDKRSLRVPKRPIINTPVVSISVHDDEELLPRALDKPVTVQFRLLETEERTKPICVFWNHSILVSGTGGWSARGCEVVFRNESHVSCQCNHMTSFAVLMDVSRRENGEILPLKTLTYVALGVTLAALLLTFFFLTLLRILRSNQHGIRRNLTAALGLAQLVFLLGINQADLPFACTVIAILLHFLYLCTFSWALLEALHLYRALTEVRDVNTGPMRFYYMLGWGVPAFITGLAVGLDPEGYGNPDFCWLSIYDTLIWSFAGPVAFAVSMSVFLYILAARASCAAQRQGFEKKGPVSGLQPSFAVLLLLSATWLLALLSVNSDTLLFHYLFATCNCIQGPFIFLSYVVLSKEVRKALKLACSRKPSPDPALTTKSTLTSSYNCPSPYADGRLYQPYGDSAGSLHSTSRSGKSQPSYIPFLLREESALNPGQGPPGLGDPGSLFLEGQDQQHDPDTDSDSDLSLEDDQSGSYASTHSSDSEEEEEEEEEEAAFPGEQGWDSLLGPGAERLPLHSTPKDGGPGPGKAPWPGDFGTTAKESSGNGAPEERLRENGDALSREGSLGPLPGSSAQPHKGILKKKCLPTISEKSSLLRLPLEQCTGSSRGSSASEGSRGGPPPRPPPRQSLQEQLNGVMPIAMSIKAGTVDEDSSGSEFLFFNFLH

SEQ ID NO: 1122 - protein, 359 aa, homo sapiens
MAPNGTASSFCLDSTACKITITVVLAVLILITVAGNVVVCLAVGLNRRLRNLTNCFIVSLAITDLLLGLLVLPFSAIYQLSCKWSFGKVFCNIYTSLDVMLCTASILNLFMISLDRYCAVMDPLRYPVLVTPVRVAISLVLIWVISITLSFLSIHLGWNSRNETSKGNHTTSKCKVQVNEVYGLVDGLVTFYLPLLIMCITYYRIFKVARDQAKRINHISSWKAATIREHKATVTLAAVMGAFIICWFPYFTAFVYRGLRGDDAINEVLEAIVLWLGYANSALNPILYAALNRDFRTGYQQLFCCRLANRNSHKTSLRSNASQLSRTQSREPRQQEEKPLKLQVWSGTEVTAPQGATDR

SEQ ID NO: 1123 - protein, 398 aa, homo sapiens
MESGLLRPAPVSEVIVLHYNYTGKLRGARYQPGAGLRADAVVCLAVCAFIVLENLAVLLVLGRHPRFHAPMFLLLGSLTLSDLLAGAAYAANILLSGPLTLKLSPALWFAREGGVFVALTASVLSLLAIALERSLTMARRGPAPVSSRGRTLAMAAAAWGVSLLLGLLPALGWNCLGRLDACSTVLPLYAKAYVLFCVLAFVGILAAICALYARIYCQVRANARRLPARPGTAGTTSTRARRKPRSLALLRTLSVVLLAFVACWGPLFLLLLLDVACPARTCPVLLQADPFLGLAMANSLLNPIIYTLTNRDLRHALLRLVCCGRHSCGRDPSGSQQSASAAEASGGLRRCLPPGLDGSFSGSERSSPQRDGLDTSGSTGSPGAPTAARTLVSEPAAD

SEQ ID NO: 1124 - protein, 419 aa, homo sapiens
MVFSAVLTAFHTGTSNTTFVVYENTYMNITLPPPFQHPDLSPLLRYSFETMAPTGLSSLTVNSTAVPTTPAAFKSLNLPLQITLSAIMIFILFVSFLGNLVVCLMVYQKAAMRSAINILLASLAFADMLLAVLNMPFALVTILTTRWIFGKFFCRVSAMFFWLFVIEGVAILLIISIDRFLIIVQRQDKLNPYRAKVLIAVSWATSFCVAFPLAVGNPDLQIPSRAPQCVFGYTTNPGYQAYVILISLISFFIPFLVILYSFMGILNTLRHNALRIHSYPEGICLSQASKLGLMSLQRPFQMSIDMGFKTRAFTTILILFAVFIVCWAPFTTYSLVATFSKHFYYQHNFFEISTWLLWLCYLKSALNPLIYYWRIKKFHDACLDMMPKSFKFLPQLPGHTKRRIRPSAVYVCGEHRTVV

SEQ ID NO: 1125 - protein, 384 aa, homo sapiens
MAATASPQPLATEDADSENSSFYYYDYLDEVAFMLCRKDAVVSFGKVFLPVFYSLIFVLGLSGNLLLLMVLLRYVPRRRMVEIYLLNLAISNLLFLVTLPFWGISVAWHWVFGSFLCKMVSTLYTINFYSGIFFISCMSLDKYLEIVHAQPYHRLRTRAKSLLLATIVWAVSLAVSIPDMVFVQTHENPKGVWNCHADFGGHGTIWKLFLRFQQNLLGFLLPLLAMIFFYSRIGCVLVRLRPAGQGRALKIAAALVVAFFVLWFPYNLTLFLHTLLDLQVFGNCEVSQHLDYALQVTESIAFLHCCFSPILYAFSSHRFRQYLKAFLAAVLGWHLAPGTAQASLSSCSESSILTAQEEMTGMNDLGERQSENYPNKEDVGNKSA

SEQ ID NO: 1126 - protein, 357 aa, homo sapiens
MADDYGSESTSSMEDYVNFNFTDFYCEKNNVRQFASHFLPPLYWLVFIVGALGNSLVILVYWYCTRVKTMTDMFLLNLAIADLLFLVTLPFWAIAAADQWKFQTFMCKVVNSMYKMNFYSCVLLIMCISVDRYIAIAQAMRAHTWREKRLLYSKMVCFTIWVLAAALCIPEILYSQIKEESGIAICTMVYPSDESTKLKSAVLTLKVILGFFLPFVVMACCYTIIIHTLIQAKKSSKHKALKVTITVLTVFVLSQFPYNCILLVQTIDAYAMFISNCAVSTNIDICFQVTQTIAFFHSCLNPVLYVFVGERFRRDLVKTLKNLGCISQAQWVSFTRREGSLKLSSMLLETTSGALSL

SEQ ID NO: 1127 - protein, 333 aa, homo sapiens
MPANYTCTRPDGDNTDFRYFIYAVTYTVILVPGLIGNILALWVFYGYMKETKRAVIFMINLAIADLLQVLSLPLRIFYYLNHDWPFGPGLCMFCFYLKYVNMYASIYFLVCISVRRFWFLMYPFRFHDCKQKYDLYISIAGWLIICLACVLFPLLRTSDDTSGNRTKCFVDLPTRNVNLAQSVVMMTIGELIGFVTPLLIVLYCTWKTVLSLQDKYPMAQDLGEKQKALKMILTCAGVFLICFAPYHFSFPLDFLVKSNEIKSCLARRVILIFHSVALCLASLNSCLDPVIYYFSTNEFRRRLSRQDLHDSIQLHAKSFVSNHTASTMTPELC

SEQ ID NO: 1128 - protein, 346 aa, homo sapiens
MYNGSCCRIEGDTISQVMPPLLIVAFVLGALGNGVALCGFCFHMKTWKPSTVYLFNLAVADFLLMICLPFRTDYYLRRRHWAFGDIPCRVGLFTLAMNRAGSIVFLTVVAADRYFKVVHPHHAVNTISTRVAAGIVCTLWALVILGTVYLLLENHLCVQETAVSCESFIMESANGWHDIMFQLEFFMPLGIILFCSFKIVWSLRRRQQLARQARMKKATRFIMVVAIVFITCYLPSVSARLYFLWTVPSSACDPSVHGALHITLSFTYMNSMLDPLVYYFSSPSFPKFYNKLKICSLKPKQPGHSKTQRPEEMPISNLGRRSCISVANSFQSQSDGQWDPHIVEWH

SEQ ID NO: 1129 - protein, 390 aa, homo sapiens
MPDTNSTINLSLSTRVTLAFFMSLVAFAIMLGNALVILAFVVDKNLRHRSSYFFLNLAISDFFVGVISIPLYIPHTLFEWDFGKEICVFWLTTDYLLCTASVYNIVLISYDRYLSVSNAVSYRTQHTGVLKIVTLMVAVWVLAFLVNGPMILVSESWKDEGSECEPGFFSEWYILAITSFLEFVIPVILVAYFNMNIYWSLWKRDHLSRCQSHPGLTAVSSNICGHSFRGRLSSRRSLSASTEVPASFHSERQRRKSSLMFSSRTKMNSNTIASKMGSFSQSDSVALHQREHVELLRARRLAKSLAILLGVFAVCWAPYSLFTIVLSFYSSATGPKSVWYRIAFWLQWFNSFVNPLLYPLCHKRFQKAFLKIFCIKKQPLPSQHSRSVSS

SEQ ID NO: 1130 - protein, 327 aa, homo sapiens
MASFKAVFVPVAYSLIFLLGVIGNVLVLVILERHRQTRSSTETFLFHLAVADLLLVFILPFAVAEGSVGWVLGTFLCKTVIALHKVNFYCSSLLLACIAVDRYLAIVHAVHAYRHRRLLSIHITCGTIWLVGFLLALPEILFAKVSQGHHNNSLPRCTFSQENQAETHAWFTSRFLYHVAGFLLPMLVMGWCYVGVVHRLRQAQRRPQRQKAVRVAILVTSIFFLCWSPYHIVIFLDTLARLKAVDNTCKLNGSLPVAITMCEFLGLAHCCLNPMLYTFAGVKFRSDLSRLLTKLGCTGPASLCQLFPSWRRSSLSESENATSLTTF

SEQ ID NO: 1131 - protein, 331 aa, homo sapiens
MITLNNQDQPVPFNSSHPDEYKIAALVFYSCIFIIGLFVNITALWVFSCTTKKRTTVTIYMMNVALVDLIFIMTLPFRMFYYAKDEWPFGEYFCQILGALTVFYPSIALWLLAFISADRYMAIVQPKYAKELKNTCKAVLACVGVWIMTLTTTTPLLLLYKDPDKDSTPATCLKISDIIYLKAVNVLNLTRLTFFFLIPLFIMIGCYLVIIHNLLHGRTSKLKPKVKEKSIRIIITLLVQVLVCFMPFHICFAFLMLGTGENSYNPWGAFTTFLMNLSTCLDVILYYIVSKQFQARVISVMLYRNYLRSMRRKSFRSGSLRSLSNINSEML

SEQ ID NO: 1132 - protein, 457 aa, homo sapiens
MRPPSPLPARWLCVLAGALAWALGPAGGQAARLQEECDYVQMIEVQHKQCLEEAQLENETIGCSKMWDNLTCWPATPRGQVVVLACPLIFKLFSSIQGRNVSRSCTDEGWTHLEPGPYPIACGLDDKAASLDEQQTMFYGSVKTGYTIGYGLSLATLLVATAILSLFRKLHCTRNYIHMHLFISFILRAAAVFIKDLALFDSGESDQCSEGSVGCKAAMVFFQYCVMANFFWLLVEGLYLYTLLAVSFFSERKYFWGYILIGWGVPSTFTMVWTIARIHFEDYGCWDTINSSLWWIIKGPILTSILVNFILFICIIRILLQKLRPPDIRKSDSSPYSRLARSTLLLIPLFGVHYIMFAFFPDNFKPEVKMVFELVVGSFQGFVVAILYCFLNGEVQAELRRKWRRWHLQGVLGWNPKYRHPSGGSNGATCSTQVSMLTRVSPGARRSSSFQAEVSLV

SEQ ID NO: 1133 - protein, 378 aa, homo sapiens
MVWGKICWFSQRAGWTVFAESQISLSCSLCLHSGDQEAQNPNLVSQLCGVFLQNETNETIHMQMSMAVGQQALPLNIIAPKAVLVSLCGVLLNGTVFWLLCCGATNPYMVYILHLVAADVIYLCCSAVGFLQVTLLTYHGVVFFIPDFLAILSPFSFEVCLCLLVAISTERCVCVLFPIWYRCHRPKYTSNVVCTLIWGLPFCINIVKSLFLTYWKHVKACVIFLKLSGLFHAILSLVMCVSSLTLLIRFLCCSQQQKATRVYAVVQISAPMFLLWALPLSVAPLITDFKMFVTTSYLISLFLIINSSANPIIYFFVGSLRKKRLKESLRVILQRALADKPEVGRNKKAAGIDPMEQPHSTQHVENLLPREHRVDVET

SEQ ID NO: 1134 - protein, 342 aa, homo sapiens
MTSNFSQPVVQLCYEDVNGSCIETPYSPGSRVILYTAFSFGSLLAVFGNLLVMTSVLHFKQLHSPTNFLIASLACADFLVGVTVMLFSMVRTVESCWYFGAKFCTLHSCCDVAFCYSSVLHLCFICIDRYIVVTDPLVYATKFTVSVSGICISVSWILPLTYSGAVFYTGVNDDGLEELVSALNCVGGCQIIVSQGWVLIDFLLFFIPTLVMIILYSKIFLIAKQQAIKIETTSSKVESSSESYKIRVAKRERKAAKTLGVTVLAFVISWLPYTVDILIDAFMGFLTPAYIYEICCWSAYYNSAMNPLIYALFYPWFRKAIKLILSGDVLKASSSTISLFLE

SEQ ID NO: 1135 - protein, 508 aa, homo sapiens
MTSTCTNSTRESNSSHTCMPLSKMPISLAHGIIRSTVLVIFLAASFVGNIVLALVLQRKPQLLQVTNRFIFNLLVTDLLQISLVAPWVVATSVPLFWPLNSHFCTALVSLTHLFAFASVNTIVVVSVDRYLSIIHPLSYPSKMTQRRGYLLLYGTWIVAILQSTPPLYGWGQAAFDERNALCSMIWGASPSYTILSVVSFIVIPLIVMIACYSVVFCAARRQHALLYNVKRHSLEVRVKDCVENEDEEGAEKKEEFQDESEFRRQHEGEVKAKEGRMEAKDGSLKAKEGSTGTSESSVEARGSEEVRESSTVASDGSMEGKEGSTKVEENSMKADKGRTEVNQCSIDLGEDDMEFGEDDINFSEDDVEAVNIPESLPPSRRNSNSNPPLPRCYQCKAAKVIFIIIFSYVLSLGPYCFLAVLAVWVDVETQVPQWVITIIIWLFFLQCCIHPYVYGYMHKTIKKEIQDMLKKFFCKEKPPKEDSHPDLPGTEGGTEGKIVPSYDSATFP

SEQ ID NO: 1136 - protein, 364 aa, homo sapiens
MAAISTSIPVISQPQFTAMNEPQCFYNESIAFFYNRSGKHLATEWNTVSKLVMGLGITVCIFIMLANLLVMVAIYVNRRFHFPIYYLMANLAAADFFAGLAYFYLMFNTGPNTRRLTVSTWLLRQGLIDTSLTASVANLLAIAIERHITVFRMQLHTRMSNRRVVVVIVVIWTMAIVMGAIPSVGWNCICDIENCSNMAPLYSDSYLVFWAIFNLVTFVVMVVLYAHIFGYVRQRTMRMSRHSSGPRRNRDTMMSLLKTVVIVLGAFIICWTPGLVLLLLDVCCPQCDVLAYEKFFLLLAEFNSAMNPIIYSYRDKEMSATFRQILCCQRSENPTGPTEGSDRSASSLNHTILAGVHSNDHSVV

SEQ ID NO: 1137 - protein, 835 aa, homo sapiens
MGGRVFLAFCVWLTLPGAETQDSRGCARWCPQNSSCVNATACRCNPGFSSFSEIITTPTETCDDINECATPSKVSCGKFSDCWNTEGSYDCVCSPGYEPVSGAKTFKNESENTCQDVDECQQNPRLCKSYGTCVNTLGSYTCQCLPGFKFIPEDPKVCTDVNECTSGQNPCHSSTHCLNNVGSYQCRCRPGWQPIPGSPNGPNNTVCEDVDECSSGQHQCDSSTVCFNTVGSYSCRCRPGWKPRHGIPNNQKDTVCEDMTFSTWTPPPGVHSQTLSRFFDKVQDLGRDSKTSSAEVTIQNVIKLVDELMEAPGDVEALAPPVRHLIATQLLSNLEDIMRILAKSLPKGPFTYISPSNTELTLMIQERGDKNVTMGQSSARMKLNWAVAAGAEDPGPAVAGILSIQNMTTLLANASLNLHSKKQAELEEIYESSIRGVQLRRLSAVNSIFLSHNNTKELNSPILFAFSHLESSDGEAGRDPPAKDVMPGPRQELLCAFWKSDSDRGGHWATEGCQVLGSKNGSTTCQCSHLSSFAILMAHYDVEDWKLTLITRVGLALSLFCLLLCILTFLLVRPIQGSRTTIHLHLCICLFVGSTIFLAGIENEGGQVGLRCRLVAGLLHYCFLAAFCWMSLEGLELYFLVVRVFQGQGLSTRWLCLIGYGVPLLIVGVSAAIYSKGYGRPRYCWLDFEQGFLWSFLGPVTFIILCNAVIFVTTVWKLTQKFSEINPDMKKLKKARALTITAIAQLFLLGCTWVFGLFIFDDRSLVLTYVFTILNCLQGAFLYLLHCLLNKKVREEYRKWACLVAGGSKYSEFTSTTSGTGHNQTRALRASESGI

SEQ ID NO: 1138 - protein, 336 aa, homo sapiens
MNNNTTCIQPSMISSMALPIIYILLCIVGVFGNTLSQWIFLTKIGKKTSTHIYLSHLVTANLLVCSAMPFMSIYFLKGFQWEYQSAQCRVVNFLGTLSMHASMFVSLLILSWIAISRYATLMQKDSSQETTSCYEKIFYGHLLKKFRQPNFARKLCIYIWGVVLGIIIPVTVYYSVIEATEGEESLCYNRQMELGAMISQIAGLIGTTFIGFSFLVVLTSYYSFVSHLRKIRTCTSIMEKDLTYSSVKRHLLVIQILLIVCFLPYSIFKPIFYVLHQRDNCQQLNYLIETKNILTCLASARSSTDPIIFLLLDKTFKKTLYNLFTKSNSAHMQSYG

SEQ ID NO: 1139 - protein, 754 aa, homo sapiens
MIVFLVFKHLFSLRLITMFFLLHFIVLINVKDFALTQGSMITPSCQKGYFPCGNLTKCLPRAFHCDGKDDCGNGADEENCGDTSGWATIFGTVHGNANSVALTQECFLKQYPQCCDCKETELECVNGDLKSVPMISNNVTLLSLKKNKIHSLPDKVFIKYTKLKKIFLQHNCIRHISRKAFFGLCNLQILYLNHNCITTLRPGIFKDLHQLTWLILDDNPITRISQRLFTGLNSLFFLSMVNNYLEALPKQMCAQMPQLNWVDLEGNRIKYLTNSTFLSCDSLTVLFLPRNQIGFVPEKTFSSLKNLGELDLSSNTITELSPHLFKDLKLLQKLNLSSNPLMYLHKNQFESLKQLQSLDLERIEIPNINTRMFQPMKNLSHIYFKNFRYCSYAPHVRICMPLTDGISSFEDLLANNILRIFVWVIAFITCFGNLFVIGMRSFIKAENTTHAMSIKILCCADCLMGVYLFFVGIFDIKYRGQYQKYALLWMESVQCRLMGFLAMLSTEVSVLLLTYLTLEKFLVIVFPFSNIRPGKRQTSVILICIWMAGFLIAVIPFWNKDYFGNFYGKNGVCFPLYYDQTEDIGSKGYSLGIFLGVNLLAFLIIVFSYITMFCSIQKTALQTTEVRNCFGREVAVANRFFFIVFSDAICWIPVFVVKILSLFRVEIPDTMTSWIVIFFLPVNSALNPILYTLTTNFFKDKLKQLLHKHQRKSIFKIKKKSLSTSIVWIEDSSSLKLGVLNKITLGDSIMKPVS

SEQ ID NO: 1140 - protein, 415 aa, homo sapiens
MGGHPQLRLVKALLLLGLNPVSASLQDQHCESLSLASNISGLQCNASVDLIGTCWPRSPAGQLVVRPCPAFFYGVRYNTTNNGYRECLANGSWAARVNYSECQEILNEEKKSKVHYHVAVIINYLGHCISLVALLVAFVLFLRLRSIRCLRNIIHWNLISAFILRNATWFVVQLTMSPEVHQSNVGWCRLVTAAYNYFHVTNFFWMFGEGCYLHTAIVLTYSTDRLRKWMFICIGWGVPFPIIVAWAIGKLYYDNEKCWFGKRPGVYTDYIYQGPMILVLLINFIFLFNIVRILMTKLRASTTSETIQYRKAVKATLVLLPLLGITYMLFFVNPGEDEVSRVVFIYFNSFLESFQGFFVSVFYCFLNSEVRSAIRKRWHRWQDKHSIRARVARAMSIPTSPTRVSFHSIKQSTAV

SEQ ID NO: 1141 - protein, 333 aa, homo sapiens
MWSCSWFNGTGLVEELPACQDLQLGLSLLSLLGLVVGVPVGLCYNALLVLANLHSKASMTMPDVYFVNMAVAGLVLSALAPVHLLGPPSSRWALWSVGGEVHVALQIPFNVSSLVAMYSTALLSLDHYIERALPRTYMASVYNTRHVCGFVWGGALLTSFSSLLFYICSHVSTRALECAKMQNAEAADATLVFIGYVVPALATLYALVLLSRVRREDTPLDRDTGRLEPSAHRLLVATVCTQFGLWTPHYLILLGHTVIISRGKPVDAHYLGLLHFVKDFSKLLAFSSSFVTPLLYRYMNQSFPSKLQRLMKKLPCGDRHCSPDHMGVQQVLA

SEQ ID NO: 1142 - protein, 393 aa, homo sapiens
METTMGFMDDNATNTSTSFLSVLNPHGAHATSFPFNFSYSDYDMPLDEDEDVTNSRTFFAAKIVIGMALVGIMLVCGIGNFIFIAALVRYKKLRNLTNLLIANLAISDFLVAIVCCPFEMDYYVVRQLSWEHGHVLCTSVNYLRTVSLYVSTNALLAIAIDRYLAIVHPLRPRMKCQTATGLIALVWTVSILIAIPSAYFTTETVLVIVKSQEKIFCGQIWPVDQQLYYKSYFLFIFGIEFVGPVVTMTLCYARISRELWFKAVPGFQTEQIRKRLRCRRKTVLVLMCILTAYVLCWAPFYGFTIVRDFFPTVFVKEKHYLTAFYIVECIAMSNSMINTLCFVTVKNDTVKYFKKIMLLHWKASYNGGKSSADLDLKTIGMPATEEVDCIRLK

SEQ ID NO: 1143 - protein, 353 aa, homo sapiens
MASSWPPLELQSSNQSQLFPQNATACDNAPEAWDLLHRVLPTFIISICFFGLLGNLFVLLVFLLPRRQLNVAEIYLANLAASDLVFVLGLPFWAENIWNQFNWPFGALLCRVINGVIKANLFISIFLVVAISQDRYRVLVHPMASRRQQRRRQARVTCVLIWVVGGLLSIPTFLLRSIQAVPDLNITACILLLPHEAWHFARIVELNILGFLLPLAAIVFFNYHILASLRTREEVSRTRCGGRKDSKTTALILTLVVAFLVCWAPYHFFAFLEFLFQVQAVRGCFWEDFIDLGLQLANFFAFTNSSLNPVIYVFVGRLFRTKVWELYKQCTPKSLAPISSSHRKEIFQLFWRN

SEQ ID NO: 1144 - protein, 339 aa, homo sapiens
MMPFCHNIINISCVKNNWSNDVRASLYSLMVLIILTTLVGNLIVIVSISHFKQLHTPTNWLIHSMATVDFLLGCLVMPYSMVRSAEHCWYFGEVFCKIHTSTDIMLSSASIFHLSFISIDRYYAVCDPLRYKAKMNILVICVMIFISWSVPAVFAFGMIFLELNFKGAEEIYYKHVHCRGGCSVFFSKISGVLTFMTSFYIPGSIMLCVYYRIYLIAKEQARLISDANQKLQIGLEMKNGISQSKERKAVKTLGIVMGVFLICWCPFFICTVMDPFLHYIIPPTLNDVLIWFGYLNSTFNPMVYAFFYPWFRKALKMMLFGKIFQKDSSRCKLFLELSS

SEQ ID NO: 1145 - protein, 438 aa, homo sapiens
MRTLLPPALLTCWLLAPVNSIHPECRFHLEIQEEETKCAELLRSQTEKHKACSGVWDNITCWRPANVGETVTVPCPKVFSNFYSKAGNISKNCTSDGWSETFPDFVDACGYSDPEDESKITFYILVKAIYTLGYSVSLMSLATGSIILCLFRKLHCTRNYIHLNLFLSFILRAISVLVKDDVLYSSSGTLHCPDQPSSWVGCKLSLVFLQYCIMANFFWLLVEGLYLHTLLVAMLPPRRCFLAYLLIGWGLPTVCIGAWTAARLYLEDTGCWDTNDHSVPWWVIRIPILISIIVNFVLFISIIRILLQKLTSPDVGGNDQSQYKRLAKSTLLLIPLFGVHYMVFAVFPISISSKYQILFELCLGSFQGLVVAVLYCFLNSEVQCELKRKWRSRCPTPSASRDYRVCGSSFSRNGSEGALQFHRGSRAQSFLQTETSVI

SEQ ID NO: 1146 - protein, 384 aa, homo sapiens
MAAQNGNTSFTPNFNPPQDHASSLSFNFSYGDYDLPMDEDEDMTKTRTFFAAKIVIGIALAGIMLVCGIGNFVFIAALTRYKKLRNLTNLLIANLAISDFLVAIICCPFEMDYYVVRQLSWEHGHVLCASVNYLRTVSLYVSTNALLAIAIDRYLAIVHPLKPRMNYQTASFLIALVWMVSILIAIPSAYFATETVLFIVKSQEKIFCGQIWPVDQQLYYKSYFLFIFGVEFVGPVVTMTLCYARISRELWFKAVPGFQTEQIRKRLRCRRKTVLVLMCILTAYVLCWAPFYGFTIVRDFFPTVFVKEKHYLTAFYVVECIAMSNSMINTVCFVTVKNNTMKYFKKMMLLHWRPSQRGSKSSADLDLRTNGVPTTEEVDCIRLK

SEQ ID NO: 1147 - protein, 423 aa, homo sapiens
MLCHRGGQLIVPIIPLCPEHSCRGRRLQNLLSGPWPKQPMELHNLSSPSPSLSSSVLPPSFSPSPSSAPSAFTTVGGSSGGPCHPTSSSLVSAFLAPILALEFVLGLVGNSLALFIFCIHTRPWTSNTVFLVSLVAADFLLISNLPLRVDYYLLHETWRFGAAACKVNLFMLSTNRTASVVFLTAIALNRYLKVVQPHHVLSRASVGAAARVAGGLWVGILLLNGHLLLSTFSGPSCLSYRVGTKPSASLRWHQALYLLEFFLPLALILFAIVSIGLTIRNRGLGGQAGPQRAMRVLAMVVAVYTICFLPSIIFGMASMVAFWLSACRSLDLCTQLFHGSLAFTYLNSVLDPVLYCFSSPNFLHQSRALLGLTRGRQGPVSDESSYQPSRQWRYREASRKAEAIGKLKVQGEVSLEKEGSSQG

SEQ ID NO: 1148 - protein, 363 aa, homo sapiens
MKGNSTLATTSKNITSGLHFGLVNISGNNESTLNCSQKPSDKHLDAIPILYYIIFVIGFLVNIVVVTLFCCQKGPKKVSSIYIFNLAVADLLLLATLPLWATYYSYRYDWLFGPVMCKVFGSFLTLNMFASIFFITCMSVDRYQSVIYPFLSQRRNPWQASYIVPLVWCMACLSSLPTFYFRDVRTIEYLGVNACIMAFPPEKYAQWSAGIALMKNILGFIIPLIFIATCYFGIRKHLLKTNSYGKNRITRDQVLKMAAAVVLAFIICWLPFHVLTFLDALAWMGVINSCEVIAVIDLALPFAILLGFTNSCVNPFLYCFVGNRFQQKLRSVFRVPITWLQGKRESMSCRKSSSLREMETFVS

SEQ ID NO: 1149 - protein, 823 aa, homo sapiens
MGGRVFLVFLAFCVWLTLPGAETQDSRGCARWCPQDSSCVNATACRCNPGFSSFSEIITTPMETCDDINECATLSKVSCGKFSDCWNTEGSYDCVCSPGYEPVSGAKTFKNESENTCQDVDECQQNPRLCKSYGTCVNTLGSYTCQCLPGFKLKPEDPKLCTDVNECTSGQNPCHSSTHCLNNVGSYQCRCRPGWQPIPGSPNGPNNTVCEDVDECSSGQHQCDSSTVCFNTVGSYSCRCRPGWKPRHGIPNNQKDTVCEDMTFSTWTPPPGVHSQTLSRFFDKVQDLGRDYKPGLANNTIQSILQALDELLEAPGDLETLPRLQQHCVASHLLDGLEDVLRGLSKNLSNGLLNFSYPAGTELSLEVQKQVDRSVTLRQNQAVMQLDWNQAQKSGDPGPSVVGLVSIPGMGKLLAEAPLVLEPEKQMLLHETHQGLLQDGSPILLSDVISAFLSNNDTQNLSSPVTFTFSHRSVIPRQKVLCVFWEHGQNGCGHWATTGCSTIGTRDTSTICRCTHLSSFAVLMAHYDVQEEDPVLTVITYMGLSVSLLCLLLAALTFLLCKAIQNTSTSLHLQLSLCLFLAHLLFLVAIDQTGHKVLCSIIAGTLHYLYLATLTWMLLEALYLFLTARNLTVVNYSSINRFMKKLMFPVGYGVPAVTVAISAASRPHLYGTPSRCWLQPEKGFIWGFLGPVCAIFSVNLVLFLVTLWILKNRLSSLNSEVSTLRNTRMLAFKATAQLFILGCTWCLGILQVGPAARVMAYLFTIINSLQGVFIFLVYCLLSQQVREQYGKWSKGIRKLKTESEMHTLSSSAKADTSKPSTVN

SEQ ID NO: 1150 - protein, 374 aa, homo sapiens
MAANVSGAKSCPANFLAAADDKLSGFQGDFLWPILVVEFLVAVASNGLALYRFSIRKQRPWHPAVVFSVQLAVSDLLCALTLPPLAAYLYPPKHWRYGEAACRLERFLFTCNLLGSVIFITCISLNRYLGIVHPFFARSHLRPKHAWAVSAAGWVLAALLAMPTLSFSHLKRPQQGAGNCSVARPEACIKCLGTADHGLAAYRAYSLVLAGLGCGLPLLLTLAAYGALGRAVLRSPGMTVAEKLRVAALVASGVALYASSYVPYHIMRVLNVDARRRWSTRCPSFADIAQATAALELGPYVGYQVMRGLMPLAFCVHPLLYMAAVPSLGCCCRHCPGYRDSWNPEDAKSTGQALPLNATAAPKPSEPQSRELSQ

SEQ ID NO: 1151 - protein, 337 aa, homo sapiens
MNSWDAGLAGLLVGTMGVSLLSNALVLLCLLHSADIRRQAPALFTLNLTCGNLLCTVVNMPLTLAGVVAQRQPAGDRLCRLAAFLDTFLAANSMLSMAALSIDRWVAVVFPLSYRAKMRLRDAALMVAYTWLHALTFPAAALALSWLGFHQLYASCTLCSRRPDERLRFAVFTGAFHALSFLLSFVVLCCTYLKVLKVARFHCKRIDVITMQTLVLLVDLHPSVRERCLEEQKRRRQRATKKISTFIGTFLVCFAPYVITRLVELFSTVPIGSHWGVLSKCLAYSKAASDPFVYSLLRHQYRKSCKEILNRLLHRRSIHSSGLTGDSHSQNILPVSE

SEQ ID NO: 1152 - protein, 528 aa, homo sapiens
MDHCGALFLCLCLLTLQNATTETWEELLSYMENMQVSRGRSSVFSSRQLHQLEQMLLNTSFPGYNLTLQTPTIQSLAFKLSCDFSGLSLTSATLKRVPQAGGQHARGQHAMQFPAELTRDACKTRPRELRLICIYFSNTHFFKDENNSSLLNNYVLGAQLSHGHVNNLRDPVNISFWHNQSLEGYTLTCVFWKEGARKQPWGGWSPEGCRTEQPSHSQVLCRCNHLTYFAVLMQLSPALVPAELLAPLTYISLVGCSISIVASLITVLLHFHFRKQSDSLTRIHMNLHASVLLLNIAFLLSPAFAMSPVPGSACTALAAALHYALLSCLTWMAIEGFNLYLLLGRVYNIYIRRYVFKLGVLGWGAPALLVLLSLSVKSSVYGPCTIPVFDSWENGTGFQNMSICWVRSPVVHSVLVMGYGGLTSLFNLVVLAWALWTLRRLRERADAPSVRACHDTVTVLGLTVLLGTTWALAFFSFGVFLLPQLFLFTILNSLYGFFLFLWFCSQRCRSEAEAKAQIEAFSSSQTTQ

SEQ ID NO: 1153 - protein, 529 aa, homo sapiens
MSLNSSLSCRKELSNLTEEEGGEGGVIITQFIAIIVITIFVCLGNLVIVVTLYKKSYLLTLSNKFVFSLTLSNFLLSVLVLPFVVTSSIRREWIFGVVWCNFSALLYLLISSASMLTLGVIAIDRYYAVLYPMVYPMKITGNRAVMALVYIWLHSLIGCLPPLFGWSSVEFDEFKWMCVAAWHREPGYTAFWQIWCALFPFLVMLVCYGFIFRVARVKARKVHCGTVVIVEEDAQRTGRKNSSTSTSSSGSRRNAFQGVVYSANQCKALITILVVLGAFMVTWGPYMVVIASEALWGKSSVSPSLETWATWLSFASAVCHPLIYGLWNKTVRKELLGMCFGDRYYREPFVQRQRTSRLFSISNRITDLGLSPHLTALMAGGQPLGHSSSTGDTGFSCSQDSGTDMMLLEDYTSDDNPPSHCTCPPKRRSSVTFEDEVEQIKEAAKNSILHVKAEVHKSLDSYAASLAKAIEAEAKINLFGEEALPGVLVTARTVPGGGFGGRRGSRTLVSQRLQLQSIEEGDVLAAEQR

SEQ ID NO: 1154 - protein, 345 aa, homo sapiens
MSSNSSLLVAVQLCYANVNGSCVKIPFSPGSRVILYIVFGFGAVLAVFGNLLVMISILHFKQLHSPTNFLVASLACADFLVGVTVMPFSMVRTVESCWYFGRSFCTFHTCCDVAFCYSSLFHLCFISIDRYIAVTDPLVYPTKFTVSVSGICISVSWILPLMYSGAVFYTGVYDDGLEELSDALNCIGGCQTVVNQNWVLTDFLSFFIPTFIMIILYGNIFLVARRQAKKIENTGSKTESSSESYKARVARRERKAAKTLGVTVVAFMISWLPYSIDSLIDAFMGFITPACIYEICCWCAYYNSAMNPLIYALFYPWFRKAIKVIVTGQVLKNSSATMNLFSEHI

SEQ ID NO: 1155 - protein, 359 aa, homo sapiens
MKSPFYRCQNTTSVEKGNSAVMGGVLFSTGLLGNLLALGLLARSGLGWCSRRPLRPLPSVFYMLVCGLTVTDLLGKCLLSPVVLAAYAQNRSLRVLAPALDNSLCQAFAFFMSFFGLSSTLQLLAMALECWLSLGHPFFYRRHITLRLGALVAPVVSAFSLAFCALPFMGFGKFVQYCPGTWCFIQMVHEEGSLSVLGYSVLYSSLMALLVLATVLCNLGAMRNLYAMHRRLQRHPRSCTRDCAEPRADGREASPQPLEELDHLLLLALMTVLFTMCSLPVIYRAYYGAFKDVKEKNRTSEEAEDLRALRFLSVISIVDPWIFIIFRSPVFRIFFHKIFIRPLRYRSRCSNSTNMESSL

SEQ ID NO: 1156 - protein, 377 aa, homo sapiens
MAADLGPWNDTINGTWDGDELGYRCRFNEDFKYVLLPVSYGVVCVPGLCLNAVALYIFLCRLKTWNASTTYMFHLAVSDALYAASLPLLVYYYARGDHWPFSTVLCKLVRFLFYTNLYCSILFLTCISVHRCLGVLRPLRSLRWGRARYARRVAGAVWVLVLACQAPVLYFVTTSARGGRVTCHDTSAPELFSRFVAYSSVMLGLLFAVPFAVILVCYVLMARRLLKPAYGTSGGLPRAKRKSVRTIAVVLAVFALCFLPFHVTRTLYYSFRSLDLSCHTLNAINMAYKVTRPLASANSCLDPVLYFLAGQRLVRFARDAKPPTGPSPATPARRRLGLRRSDRTDMQRIEDVLGSSEDSRRTESTPAGSENTKDIRL

SEQ ID NO: 1157 - protein, 447 aa, homo sapiens
MELLKLNRSVQGTGPGPGASLCRPGAPLLNSSSVGNLSCEPPRIRGAGTRELELAIRITLYAVIFLMSVGGNMLIIVVLGLSRRLRTVTNAFLLSLAVSDLLLAVACMPFTLLPNLMGTFIFGTVICKAVSYLMGVSVSVSTLSLVAIALERYSAICRPLQARVWQTRSHAARVIVATWLLSGLLMVPYPVYTVVQPVGPRVLQCVHRWPSARVRQTWSVLLLLLLFFIPGVVMAVAYGLISRELYLGLRFDGDSDSDSQSRVRNQGGLPGAVHQNGRCRPETGAVGEDSDGCYVQLPRSRPALELTALTAPGPGSGSRPTQAKLLAKKRVVRMLLVIVVLFFLCWLPVYSANTWRAFDGPGAHRALSGAPISFIHLLSYASACVNPLVYCFMHRRFRQACLETCARCCPRPPRARPRALPDEDPPTPSIASLSRLSYTTISTLGPG

SEQ ID NO: 1158 - protein, 363 aa, homo sapiens [sequence omitted]

SEQ ID NO: 1159 - protein, 468 aa, homo sapiens
MAGVVHVSLAALLLLPMAPAMHSDCIFKKEQAMCLEKIQRANELMGFNDSSPGCPGMWDNITCWKPAHVGEMVLVSCPELFRIFNPDQVWETETIGESDFGDSNSLDLSDMGVVSRNCTEDGWSEPFPHYFDACGFDEYESETGDQDYYYLSVKALYTVGYSTSLVTLTTAMVILCRFRKLHCTRNFIHMNLFVSFMLRAISVFIKDWILYAEQDSNHCFISTVECKAVMVFFHYCVVSNYFWLFIEGLYLFTLLVETFFPERRYFYWYTIIGWGTPTVCVTVWATLRLYFDDTGCWDMNDSTALWWVIKGPVVGSIMVNFVLFIGIIVILVQKLQSPDMGGNESSIYLRLARSTLLLIPLFGIHYTVFAFSPENVSKRERLVFELGLGSFQGFVVAVLYCFLNGEVQAEIKRKWRSWKVNRYFAVDFKHRHPSLASSGVNGGTQLSILSKSSSQIRMSGLPADNLAT

SEQ ID NO: 1160 - protein, 359 aa, homo sapiens
MQVPNSTGPDNATLQMLRNPAIAVALPVVYSLVAAVSIPGNLFSLWVLCRRMGPRSPSVIFMINLSVTDLMLASVLPFQIYYHCNRHHWVFGVLLCNVVTVAFYANMYSSILTMTCISVERFLGVLYPLSSKRWRRRRYAVAACAGTWLLLLTALSPLARTDLTYPVHALGIITCFDVLKWTMLPSVAMWAVFLFTIFILLFLIPFVITVACYTATILKLLRTEEAHGREQRRRAVGLAAVVLLAFVTCFAPNNFVLLAHIVSRLFYGKSYYHVYKLTLCLSCLNNCLDPFVYYFASREFQLRLREYLGCRRVPRDTLDTRRESLFSARTTSVRSEAGAHPEGMEGATRPGLQRQESVF

SEQ ID NO: 1161 - protein, 335 aa, homo sapiens
MESSFSFGVILAVLASLIIATNTLVAVAVLLLIHKNDGVSLCFTLNLAVADTLIGVAISGLLTDQLSSPSRPTQKTLCSLRMAFVTSSAAASVLTVMLITFDRYLAIKQPFRYLKIMSGFVAGACIAGLWLVSYLIGFLPLGIPMFQQTAYKGQCSFFAVFHPHFVLTLSCVGFFPAMLLFVFFYCDMLKIASMHSQQIRKMEHAGAMAGGYRSPRTPSDFKALRTVSVLIGSFALSWTPFLITGIVQVACQECHLYLVLERYLWLLGVGNSLLNPLIYAYWQKEVRLQLYHMALGVKKVLTSFLLFLSARNCGPERPRESSCHIVTISSSEFDG

SEQ ID NO: 1162 - protein, 333 aa, homo sapiens
MQAAGHPEPLDSRGSFSLPTMGANVSQDNGTGHNATFSEPLPFLYVLLPAVYSGICAVGLTGNTAVILVILRAPKMKTVTNVFILNLAVADGLFTLVLPVNIAEHLLQYWPFGELLCKLVLAVDHYNIFSSIYFLAVMSVDRYLVVLATVRSRHMPWRTYRGAKVASLCVWLGVTVLVLPFFSFAGVYSNELQVPSCGLSFPWPEQVWFKASRVYTLVLGFVLPVCTICVLYTDLLRRLRAVRLRSGAKALGKARRKVTVLVLVVLAVCLLCWTPFHLASVVALTTDLPQTPLVISMSYVITSLSYANSCLNPFLYAFLDDNFRKNFRSILRC

SEQ ID NO: 1163 - protein, 350 aa, homo sapiens
MALEQNQSTDYYYEENEMNGTYDYSQYELICIKEDVREFAKVFLPVFLTIVFVIGLAGNSMVVAIYAYYKKQRTKTDVYILNLAVADLLLLFTLPFWAVNAVHGWVLGKIMCKITSALYTLNFVSGMQFLACISIDRYVAVTKVPSQSGVGKPCWIICFCVWMAAILLSIPQLVFYTVNDNARCIPIFPRYLGTSMKALIQMLEICIGFVVPFLIMGVCYFITARTLMKMPNIKISRPLKVLLTVVIVFIVTQLPYNIVKFCRAIDIIYSLITSCNMSKRMDIAIQVTESIALFHSCLNPILYVFMGASFKNYVMKVAKKYGSWRRQRQSVEEFPFDSEGPTEPTSTFSI

SEQ ID NO: 1164 - protein, 372 aa, homo sapiens
MACNSTSLEAYTYLLLNTSNASDSGSTQLPAPLRISLAIVMLLMTVVGFLGNTVVCIIVYQRPAMRSAINLLLATLAFSDIMLSLCCMPFTAVTLITVRWHFGDHFCRLSATLYWFFVLEGVAILLIISVDRFLIIVQRQDKLNPRRAKVIIAVSWVLSFCIAGPSLTGWTLVEVPARAPQCVLGYTELPADRAYVVTLVVAVFFAPFGVMLCAYMCILNTVRKNAVRVHNQSDSLDLRQLTRAGLRRLQRQQQVSVDLSFKTKAFTTILILFVGFSLCWLPHSVYSLLSVFSQRFYCGSSFYATSTCVLWLSYLKSVFNPIVYCWRIKKFREACIELLPQTFQILPKVPERIRRRIQPSTVYVCNENQSAV

SEQ ID NO: 1165 - protein, 362 aa, homo sapiens
MDLHLFDYSEPGNFSDISWPCNSSDCIVVDTVMCPNMPNKSVLLYTLSFIYIFIFVIGMIANSVVVWVNIQAKTTGYDTHCYILNLAIADLWVVLTIPVWVVSLVQHNQWPMGELTCKVTHLIFSINLFGSIFFLTCMSVDRYLSITYFTNTPSSRKKMVRRVVCILVWLLAFCVSLPDTYYLKTVTSASNNETYCRSFYPEHSIKEWLIGMELVSVVLGFAVPFSIIAVFYFLLARAISASSDQEKHSSRKIIFSYVVVFLVCWLPYHVAVLLDIFSILHYIPFTCRLEHALFTALHVTQCLSLVHCCVNPVLYSFINRNYRYELMKAFIFKYSAKTGLTKLIDASRVSETEYSALEQSTK

SEQ ID NO: 1166 - protein, 695 aa, homo sapiens
MALLLVSLLAFLSLGSGCHHRICHCSNRVFLCQESKVTEIPSDLPRNAIELRFVLTKLRVIQKGAFSGFGDLEKIEISQNDVLEVIEADVFSNLPKLHEIRIEKANNLLYINPEAFQNLPNLQYLLISNTGIKHLPDVHKIHSLQKVLLDIQDNINIHTIERNSFVGLSFESVILWLNKNGIQEIHNCAFNGTQLDELNLSDNNNLEELPNDVFHGASGPVILDISRTRIHSLPSYGLENLKKLRARSTYNLKKLPTLEKLVALMEASLTYPSHCCAFANWRRQISELHPICNKSILRQEVDYMTQARGQRSSLAEDNESSYSRGFDMTYTEFDYDLCNEVVDVTCSPKPDAFNPCEDIMGYNILRVLIWFISILAITGNIIVLVILTTSQYKLTVPRFLMCNLAFADLCIGIYLLLIASVDIHTKSQYHNYAIDWQTGAGCDAAGFFTVFASELSVYTLTAITLERWHTITHAMQLDCKVQLRHAASVMVMGWIFAFAAALFPIFGISSYMKVSICLPMDIDSPLSQLYVMSLLVLNVLAFVVICGCYIHIYLTVRNPNIVSSSSDTRIAKRMAMLIFTDFLCMAPISFFAISASLKVPLITVSKAKILLVLFHPINSCANPFLYAIFTKNFRRDFFILLSKCGCYEMQAQIYRTETSSTVHNTHPRNGHCSSAPRVTSGSTYILVPLSHLAQN

SEQ ID NO: 1167 - protein, 358 aa, homo sapiens
MGNASNDSQSEDCETRQWLPPGESPAISSVMFSAGVLGNLIALALLARRWRGDVGCSAGRRSSLSLFHVLVTELVFTDLLGTCLISPVVLASYARNQTLVALAPESRACTYFAFAMTFFSLATMLMLFAMALERYLSIGHPYFYQRRVSRSGGLAVLPVIYAVSLLFCSLPLLDYGQYVQYCPGTWCFIRHGRTAYLQLYATLLLLLIVSVLACNFSVILNLIRMHRRSRRSRCGPSLGSGRGGPGARRRGERVSMAEETDHLILLAIMTITFAVCSLPFTIFAYMNETSSRKEKWDLQALRFLSINSIIDPWVFAILRPPVLRLMRSVLCCRISLRTQDATQTSCSTQSDASKQADL

SEQ ID NO: 1168 - protein, 352 aa, homo sapiens
MNTTSSAAPPSLGVEFISLLAIILLSVALAVGLPGNSFVVWSILKRMQKRSVTALMVLNLALADLAVLLTAPFFLHFLAQGTWSFGLAGCRLCHYVCGVSMYASVLLITAMSLDRSLAVARPFVSQKLRTKAMARRVLAGIWVLSFLLATPVLAYRTVVPWKTNMSLCFPRYPSEGHRAFHLIFEAVTGFLLPFLAVVASYSDIGRRLQARRFRRSRRTGRLVVLIILTFAAFWLPYHVVNLAEAGRALAGQAAGLGLVGKRLSLARNVLIALAFLSSSVNPVLYACAGGGLLRSAGVGFVAKLLEGTGSEASSTRRGGSLGQTARSGPAALEPGPSESLTASSPLKLNELN

SEQ ID NO: 1169 - protein, 494 aa, homo sapiens
MEEPQPPRPPASMALLGSQHSGAPSAAGPPGGTSSAATAAVLSFSTVATAALGNLSDASGGGTAAAPGGGGLGGSGAAREAGAAVRRPLGPEAAPLLSHGAAVAAQALVLLLIFLLSSLGNCAVMGVIVKHRQLRTVTNAFILSLSLSDLLTALLCLPAAFLDLFTPPGGSAPAAAAGPWRGFCAASRFFSSCFGIVSTLSVALISLDRYCAIVRPPREKIGRRRALQLLAGAWLTALGFSLPWELLGAPRELAAAQSFHGCLYRTSPDPAQLGAAFSVGLVVACYLLPFLLMCFCHYHICKTVRLSDVRVRPVNTYARVLRFFSEVRTATTVLIMIVFVICCWGPYCFLVLLAAARQAQTMQAPSLLSVVAVWLTWANGAINPVIYAIRNPNISMLLGRNREEGYRTRNVDAFLPSQGPGLQARSRSRLRNRYANRLGACNRMSSSNPASGVAGDVAMWARKNPVVLFCREGPPEPVTAVTKQPKSEAGDTSL

SEQ ID NO: 1170 - protein, 389 aa, homo sapiens
MEGALAANWSAEAANASAAPPGAEGNRTAGPPRRNEALARVEVAVLCLILLLALSGNACVLLALRTTRQKHSRLFFFMKHLSIADLVVAVFQVLPQLLWDITFRFYGPDLLCRLVKYLQVVGMFASTYLLLLMSLDRCLAICQPLRSLRRRTDRLAVLATWLGCLVASAPQVHIFSLREVADGVFDCWAVFIQPWGPKAYITWITLAVYIVPVIVLAACYGLISFKIWQNLRLKTAAAAAAEAPEGAAAGDGGRVALARVSSVKLISKAKIRTVKMTFIIVLAFIVCWTPFFFVQMWSVWDANAPKEASAFIIVMLLASLNSCCNPWIYMLFTGHLFHELVQRFLCCSASYLKGRRLGETSASKKSNSSSFVLSHRSSSQRSCSQPSTA

SEQ ID NO: 1171 - protein, 411 aa, homo sapiens
MDAALLHSLLEANCSLALAEELLLDGWGPPLDPEGPYSYCNTTLDQIGTCWPRSAAGALVERPCPEYFNGVKYNTTRNAYRECLENGTWASKINYSQCEPILDDKQRKYDLHYRIALVVNYLGHCVSVAALVAAFLLFLALRSIRCLRNVIHWNLITTFILRNVMWFLLQLVDHEVHESNEVWCRCITTIFNYFVVTNFFWMFVEGCYLHTAIVMTYSTERLRKCLFLFIGWCIPFPIIVAWAIGKLYYENEQCWFGKEPGDLVDYIYQGPIILVLLINFVFLFNIVRILMTKLRASTTSETIQYRKAVKATLVLLPLLGITYMLFFVNPGEDDLSQIMFIYFNSFLQSFQGFFVSVFYCFFNGEVRSAVRKRWHRWQDHHSLRVPMARAMSIPTSPTRISFHSIKQTAAV

SEQ ID NO: 1172 - protein, 462 aa, homo sapiens
MSIMMLPMEQKIQWVPTSLQDITAVLGTEAYTEEDKSMVSHAQKSQHSCLSHSRWLRSPQVTGGSWDLRIRPSKDSSSFRQAQCLRKDPGANNHLESQGVRGTAGDADRELRGPSEKATAGQPRVTLLPTPHVSGLSQEFESHWPEIAERSPCVAGVIPVIYYSVLLGLGLPVSLLTAVALARLATRTRRPSYYYLLALTASDIIIQVVIVFAGFLLQGAVLARQVPQAVVRTANILEFAANHASVWIAILLTVDRYTALCHPLHHRAASSPGRTRRAIAAVLSAALLTGIPFYWWLDMWRDTDSPRTLDEVLKWAHCLTVYFIPCGVFLVTNSAIIHRLRRRGRSGLQPRVGKSTAILLGITTLFTLLWAPRVFVMLYHMYVAPVHRDWRVHLALDVANMVAMLHTAANFGLYCFVSKTFRATVRQVIHDAYLPCTLASQPEGMAAKPVMEPPGLPTGAEV

SEQ ID NO: 1173 - protein, 305 aa, homo sapiens
MPGHNTSRNSSCDPIVTPHLISLYFIVLIGGLVGVISILFLLVKMNTRSVTTMAVINLVVVHSVFLLTVPFRLTYLIKKTWMFGLPFCKFVSAMLHIHMYLTFLFYVVILVTRYLIFFKCKDKVEFYRKLHAVAASAGMWTLVIVIVVPLVVSRYGIHEEYNEEHCFKFHKELAYTYVKIINYMIVIFVIAVAVILLVFQVFIIMLMVQKLRHSLLSHQEFWAQLKNLFFIGVILVCFLPYQFFRIYYLNVVTHSNACNSKVAFYNEIFLSVTAISCYDLLLFVFGGSHWFKQKIIGLWNCVLCR

SEQ ID NO: 1174 - protein, 419 aa, homo sapiens
MGNRSTADADGLLAGRGPAAGASAGASAGLAGQGAAALVGGVLLIGAVLAGNSLVCVSVATERALQTPTNSFIVSLAAADLLLALLVLPLFVYSEVQGGAWLLSPRLCDALMAMDVMLCTASIFNLCAISVDRFVAVAVPLRYNRQGGSRRQLLLIGATWLLSAAVAAPVLCGLNDVRGRDPAVCRLEDRDYVVYSSVCSFFLPCPLMLLLYWATFRGLQRWEVARRAKLHGRAPRRPSGPGPPSPTPPAPRLPQDPCGPDCAPPAPGLPRGPCGPDCAPAAPSLPQDPCGPDCAPPAPGLPPDPCGSNCAPPDAVRAAALPPQTPPQTRRRRRAKITGRERKAMRVLPVVVGAFLLCWTPFFVVHITQALCPACSVPPRLVSAVTWLGYVNSALNPVIYTVFNAEFRNVFRKALRACC

SEQ ID NO: 1175 - protein, 374 aa, homo sapiens
MPTLNTSASPPTFFWANASGGSVLSADDAPMPVKFLALRLMVALAYGLVGAIGLLGNLAVLWVLSNCARRAPGPPSDTFVFNLALADLGLALTLPFWAAESALDFHWPFGGALCKMVLTATVLNVYASIFLITALSVARYWVVAMAAGPGTHLSLFWARIATLAVWAAAALVTVPTAVFGVEGEVCGVRLCLLRFPSRYWLGAYQLQRVVLAFMVPLGVITTSYLLLLAFLQRRQRRRQDSRVVARSVRILVASFFLCWFPNHVVTLWGVLVKFDLVPWNSTFYTIQTYVFPVTTCLAHSNSCLNPVLYCLLRREPRQALAGTFRDLRLRLWPQGGGWVQQVALKQVGRRWVASNPRESRPSTLLTNLDRGTPG

SEQ ID NO: 1176 - protein, 450 aa, homo sapiens
MDHQDPYSVQATAAIAAAITFLILFTIFGNALVILAVLTSRSLRAPQNLFLVSLAAADILVATLIIPFSLANELLGYWYFRRTWCEVYLALDVLFCTSSIVHLCAISLDRYWAVSRALEYNSKRTPRRIKCIILTVWLIAAVISLPPLIYKGDQGPQPRGRPQCKLNQEAWYILASSIGSFFAPCLIMILVYLRIYLIAKRSNRRGPRAKGGPGQGESKQPRPDHGGALASAKLPALASVASAREVNGHSKSTGEKEEGETPEDTGTRALPPSWAALPNSGQGQKEGVCGASPEDEAEEEEEEEEEEEECEPQAVPVSPASACSPPLQQPQGSRVLATLRGQVLLGRGVGAIGGQWWRRRAQLTREKRFTFVLAVVIGVFVLCWFPFFFSYSLGAICPKHCKVPHGLFQFFFWIGYCNSSLNPVIYTIFNQDFRRAFRRILCRPWTQTAW

SEQ ID NO: 1177 - protein, 309 aa, homo sapiens
MNGTYNTCGSSDLTWPPAIKLGFYAYLGVLLVLGLLLNSLALWVFCCRMQQWTETRIYMTNLAVADLCLLCTLPFVLHSLRDTSDTPLCQLSQGIYLTNRYMSISLVTAIAVDRYVAVRHPLRARGLRSPRQAAAVCAVLWVLVIGSLVARWLLGIQEGGFCFRSTRHNFNSMAFPLLGFYLPLAVVVFCSLKVVTALAQRPPTDVGQAEATRKAARMVWANLLVFVVCFLPLHVGLTVRLAVGWNACALLETIRRALYITSKLSDANCCLDAICYYYMAKEFQEASALAVAPSAKAHKSQDSLCVTLA

SEQ ID NO: 1178 - protein, 337 aa, homo sapiens
MNSTCIEEQHDLDHYLFPIVYIFVIIVSIPANIGSLCVSFLQAKKESELGIYLFSLSLSDLLYALTLPLWIDYTWNKDNWTFSPALCKGSAFLMYMNFYSSTAFLTCIAVDRYLAVVYPLKFFFLRTRRFALMVSLSIWILETIFNAVMLWEDETVVEYCDAEKSNFTLCYDKYPLEKWQINLNLFRTCTGYAIPLVTILICNRKVYQAVRHNKATENKEKKRIIKLLVSITVTFVLCFTPFHVMLLIRCILEHAVNFEDHSNSGKRTYTMYRITVALTSLNCVADPILYCFVTETGRYDMWNILKFCTGRCNTSQRQRKRILSVSTKDTMELEVLE

SEQ ID NO: 1179 - protein, 319 aa, homo sapiens
MSQQNTSGDCLFDGVNELMKTLQFAVHIPTFVLGLLLNLLAIHGFSTFLKNRWPDYAATSIYMINLAVFDLLLVLSLPFKMVLSQVQSPFPSLCTLVECLYFVSMYGSVFTICFISMDRFLAIRYPLLVSHLRSPRKIFGICCTIWVLVWTGSIPIYSFHGKVEKYMCFHNMSDDTWSAKVFFPLEVFGFLLPMGIMGFCCSRSIHILLGRRDHTQDWVQQKACIYSIAASLAVFVVSFLPVHLGFFLQFLVRNSFIVECRAKQSISFFLQLSMCFSNVNCCLDVFCYYFVIKEFRMNIRAHRPSRVQLVLQDTTISRG

SEQ ID NO: 1180 - protein, 344 aa, homo sapiens
MVSVNSSHCFYNDSFKYTLYGCMFSMVFVLGLISNCVAIYIFICVLKVRNETTTYMINLAMSDLLFVFTLPFRIFYFTTRNWPFGDLLCKISVMLFYTNMYGSILFLTCISVDRFLAIVYPFKSKTLRTKRNAKIVCTGVWLTVIGGSAPAVFVQSTHSQGNNASEACFENFPEATWKTYLSRIVIFIEIVGFFIPLILNVTCSSMVLKTLTKPVTLSRSKINKTKVLKMIFVHLIIFCFCFVPYNINLILYSLVRTQTFVNCSVVAAVRTMYPITLCIAVSNCCFDPIVYYFTSDTIQNSIKMKNWSVRRSDFRFSEVHGAENFIQHNLQTLKSKIFDNESAA

SEQ ID NO: 1181 - protein, 397 aa, homo sapiens
MRSPSAAWLLGAAILLAASLSCSGTIQGTNRSSKGRSLIGKVDGTSHVTGKGVTVETVFSVDEFSASVLTGKLTTVFLPIVYTIVFVVGLPSNGMALWVFLFRTKKKHPAVIYMANLALADLLSVIWFPLKIAYHIHGNNWIYGEALCNVLIGFFYGNMYCSILFMTCLSVQRYWVIVNPMGHSRKKANIAIGISLAIWLLILLVTIPLYVVKQTIFIPALNITTCHDVLPEQLLVGDMFNYFLSLAIGVFLFPAFLTASAYVLMIRMLRSSAMDENSEKKRKRAIKLIVTVLAMYLICFTPSNLLLVVHYFLIKSQGQSHVYALYIVALCLSTLNSCIDPFVYYFVSHDFRDHAKNALLCRSVRTVKQMQVSLTSKKHSRKSSSYSSSSTTVKTSY

SEQ ID NO: 1182 - protein, 355 aa, homo sapiens
MEDLEETLFEEFENYSYDLDYYSLESDLEEKVQLGVVHWVSLVLYCLAFVLGIPGNAIVIWFTGFKWKKTVTTLWFLNLAIADFIFLLFLPLYISYVAMNFHWPFGIWLCKANSFTAQLNMFASVFFLTVISLDHYIHLIHPVLSHRHRTLKNSLIVIIFIWLLASLIGGPALYFRDTVEFNNHTLCYNNFQKHDPDLTLIRHHVLTWVKFIIGYLFPLLTMSICYLCLIFKVKKRSILISSRHFWTILVVVVAFVVCWTPYHLFSIWELTIHHNSYSHHVMQAGIPLSTGLAFLNSCLNPILYVLISKKFQARFRSSVAEILKYTLWEVSCSGTVSEQLRNSETKNLCLLETAQ

SEQ ID NO: 1183 - protein, 363 aa, homo sapiens
MGPGEALLAGLLVMVLAVALLSNALVLLCCAYSAELRTRASGVLLVNLSLGHLLLAALDMPFTLLGVMRGRTPSAPGACQVIGFLDTFLASNAALSVAALSADQWLAVGFPLRYAGRLRPRYAGLLLGCAWGQSLAFSGAALGCSWLGYSSAFASCSLRLPPEPERPRFAAFTATLHAVGFVLPLAVLCLTSLQVHRVARRHCQRMDTVTMKALALLADLHPSVRQRCLIQQKRRRHRATRKIGIAIATFLICFAPYVMTRLAELVPFVTVNAQWGILSKCLTYSKAVADPFTYSLLRRPFRQVLAGMVHRLLKRTPRPASTHDSSLDVAGMVHQLLKRTPRPASTHNGSVDTENDSCLQQTH

SEQ ID NO: 1184 - protein, 374 aa, homo sapiens
MSGESMNFSDVFDSSEDYFVSVNTSYYSVDSEMLLCSLQEVRQFSRLFVPIAYSLICVFGLLGNILVVITFAFYKKARSMTDVYLLNMAIADILFVLTLPFWAVSHATGAWVFSNATCKLLKGIYAINFNCGMLLLTCISMDRYIAIVQATKSFRLRSRTLPRSKIICLVVWGLSVIISSSTFVFNQKYNTQGSDVCEPKYQTVSEPIRWKLLMLGLELLFGFFIPLMFMIFCYTFIVKTLVQAQNSKRHKAIRVIIAVVLVFLACQIPHNMVLLVTAANLGKMNRSCQSEKLIGYTKTVTEVLAFLHCCLNPVLYAFIGQKFRNYFLKILKDLWCVRRKYKSSGFSCAGRYSENISRQTSETADNDNASSFTM

SEQ ID NO: 1185 - protein, 1078 aa, homo sapiens
MAFYSCCWVLLALTWHTSAYGPDQRAQKKGDIILGGLFPIHFGVAAKDQDLKSRPESVECIRYNFRGFRWLQAMIFAIEEINSSPALLPNLTLGYRIFDTCNTVSKALEATLSFVAQNKIDSLNLDEFCNCSEHIPSTIAVVGATGSGVSTAVANLLGLFYIPQVSYASSSRLLSNKNQFKSFLRTIPNDEHQATAMADIIEYFRWNWVGTIAADDDYGRPGIEKFREEAEERDICIDFSELISQYSDEEEIQHVVEVIQNSTAKVIVVFSSGPDLEPLIKEIVRRNITGKIWLASEAWASSSLIAMPQYFHVVGGTIGFALKAGQIPGFREFLKKVHPRKSVHNGFAKEFWEETFNCHLQEGAKGPLPVDTFLRGHEESGDRFSNSSTAFRPLCTGDENISSVETPYIDYTHLRISYNVYLAVYSIAHALQDIYTCLPGRGLFTNGSCADIKKVEAWQVLKHLRHLNFTNNMGEQVTFDECGDLVGNYSIINWHLSPEDGSIVFKEVGYYNVYAKKGERLFINEEKILWSGFSREVPFSNCSRDCLAGTRKGIIEGEPTCCFECVECPDGEYSDETDASACNKCPDDFWSNENHTSCIAKEIEFLSWTEPFGIALTLFAVLGIFLTAFVLGVFIKFRNTPIVKATNRELSYLLLFSLLCCFSSSLFFIGEPQDWTCRLRQPAFGISFVLCISCILVKTNRVLLVFEAKIPTSFHRKWWGLNLQFLLVFLCTFMQIVICVIWLYTAPPSSYRNQELEDEIIFITCHEGSLMALGFLIGYTCLLAAICFFFAFKSRKLPENFNEAKFITFSMLIFFIVWISFIPAYASTYGKFVSAVEVIAILAASFGLLACIFFNKIYIILFKPSRNTIEEVRCSTAAHAFKVAARATLRRSNVSRKRSSSLGGSTGSTPSSSISSKSNSEDPFPQPERQKQQQPLALTQQEQQQQPLTLPQQQRSQQQPRCKQKVIFGSGTVTFSLSFDEPQKNAMAHRNSTHQNSLEAQKSSDTLTRHQPLLPLQCGETDLDLTVQETGLQGPVGGDQRPEVEDPEELSPALVVSSSQSFVISGGGSTVTENVVNS

SEQ ID NO: 1186 - protein, 460 aa, homo sapiens
MNTSAPPAVSPNITVLAPGKGPWQVAFIGITTGLLSLATVTGNLLVLISFKVNTELKTVNNYFLLSLACADLIIGTFSMNLYTTYLLMGHWALGTLACDLWLALDYVASNASVMNLLLISFDRYFSVTRPLSYRAKRTPRRAALMIGLAWLVSFVLWAPAILFWQYLVGERTVLAGQCYIQFLSQPIITFGTAMAAFYLPVTVMCTLYWRIYRETENRARELAALQGSETPGKGGGSSSSSERSQPGAEGSPETPPGRCCRCCRAPRLLQAYSWKEEEEEDEGSMESLTSSEGEEPGSEVVIKMPMVDPEAQAPTKQPPRSSPNTVKRPTKKGRDRAGKGQKPRGKEQLAKRKTFSLVKEKKAARTLSAILLAFILTWTPYNIMVLVSTFCKDCVPETLWELGYWLCYVNSTINPMCYALCNKAFRDTFRLLLLCRWDKRRWRKIPKRPGSVHRTPSRQC

SEQ ID NO: 1187 - protein, 361 aa, homo sapiens
MAPTEPWSPSPGSAPWDYSGLDGLEELELCPAGDLPYGYVYIPALYLAAFAVGLLGNAFVVWLLAGRRGPRRLVDTFVLHLAAADLGFVLTLPLWAAAAALGGRWPFGDGLCKLSSFALAGTRCAGALLLAGMSVDRYLAVVKLLEARPLRTPRCALASCCGVWAVALLAGLPSLVYRGLQPLPGGQDSQCGEEPSHAFQGLSLLLLLLTFVLPLVVTLFCYCRISRRLRRPPHVGRARRNSLRIIFAIESTFVGSWLPFSALRAVFHLARLGALPLPCPLLLALRWGLTIATCLAFVNSCANPLIYLLLDRSFRARALDGACGRTGRLARRISSASSLSRDDSSVFRCRAQAANTASASW

SEQ ID NO: 1188 - protein, 366 aa, homo sapiens
MWNATPSEEPGFNLTLADLDWDASPGNDSLGDELLQLFPAPLLAGVTATCVALFVVGIAGNLLTMLVVSRFRELRTTTNLYLSSMAFSDLLIFLCMPLDLVRLWQYRPWNFGDLLCKLFQFVSESCTYATVLTITALSVERYFAICFPLRAKVVVTKGRVKLVIFVIWAVAFCSAGPIFVLVGVEHENGTDPWDTNECRPTEFAVRSGLLTVMVWVSSIFFFLPVFCLTVLYSLIGRKLWRRRRGDAVVGASLRDQNHKQTVKMLAVVVFAFILCWLPFHVGRYLFSKSFEPGSLEIAQISQYCNLVSFVLFYLSAAINPILYNIMSKKYRVAVFRLLGFEPFSQRKLSTLKDESSRAWTESSINT

SEQ ID NO: 1189 - protein, 353 aa, homo sapiens
METNFSIPLNETEEVLPEPAGHTVLWIFSLLVHGVTFVFGVLGNGLVIWVAGFRMTRTVNTICYLNLALADFSFSAILPFRMVSVAMREKWPFGSFLCKLVHVMIDINLFVSVYLITIIALDRCICVLHPAWAQNHRTMSLAKRVMTGLWIFTIVLTLPNFIFWTTISTTNGDTYCIFNFAFWGDTAVERLNVFITMAKVFLILHFIIGFSVPMSIITVCYGIIAAKIHRNHMIKSSRPLRVFAAVVASFFICWFPYELIGILMAVWLKEMLLNGKYKIILVLINPTSSLAFFNSCLNPILYVFMGRNFQERLIRSLPTSLERALTEVPDSAQTSNTDTTSASPPEETELQAM

SEQ ID NO: 1190 - protein, 425 aa, homo sapiens
MKETRGYGGDAPFCTRLNHSYTGMWAPERSAEARGNLTRPPGSGEDCGSVSVAFPITMLLTGFVGNALAMLLVSRSYRRRESKRKKSFLLCIGWLALTDLVGQLLTTPVVIVVYLSKQRWEHIDPSGRLCTFFGLTMTVFGLSSLFIASAMAVERALAIRAPHWYASHMKTRATRAVLLGVWLAVLAFALLPVLGVGQYTVQWPGTWCFISTGRGGNGTSSSHNWGNLFFASAFAFLGLLALTVTFSCNLATIKALVSRCRAKATASQSSAQWGRITTETAIQLMGIMCVLSVCWSPLLIMMLKMIFNQTSVEHCKTHTEKQKECNFFLIAVRLASLNQILDPWVYLLLRKILLRKFCQMRKRRLREQAPLLPTSTVIDPSRFCAQPFRWFLDLSFPAMSSSHPQLPLTLASFKLLREPCSVQLS

SEQ ID NO: 1191 - protein, 402 aa, homo sapiens
MSPCGPLNLSLAGEATTCAAPWVPNTSAVPPSGASPALPIFSMTLGAVSNLLALALLAQAAGRLRRRRSAATFLLFVASLLATDLAGHVIPGALVLRLYTAGRAPAGGACHFLGGCMVFFGLCPLLLGCGMAVERCVGVTRPLLHAARVSVARARLALAAVAAVALAVALLPLARVGRYELQYPGTWCFIGLGPPGGWRQALLAGLFASLGLVALLAALVCNTLSGLALLRARWRRRSRRPPPASGPDSRRRWGAHGPRSASASSASSIASASTFFGGSRSSGSARRARAHDVEMVGQLVGIMVVSCICWSPMLVLVALAVGGWSSTSLQRPLFLAVRLASWNQILDPWVYILLRQAVLRQLLRLLPPRAGAKGGPAGLGLTPSAWEASSLRSSRHSGLSHF

SEQ ID NO: 1192 - protein, 354 aa, homo sapiens
MALNHTALPQDERLPHYLRDGDPFASKLSWEADLVAGFYLTIIGILSTFGNGYVLYMSSRRKKKLRPAEIMTINLAVCDLGISVVGKPFTIISCFCHRWVFGWIGCRWYGWAGFFFGCGSLITMTAVSLDRYLKICYLSYGVWLKRKHAYICLAAIWAYASFWTTMPLVGLGDYVPEPFGTSCTLDWWLAQASVGGQVFILNILFFCLLLPTAVIVFSYVKIIAKVKSSSKEVAHFDSRIHSSHVLEMKLTKVAMLICAGFLIAWIPYAVVSVWSAFGRPDSIPIQLSVVPTLLAKSAAMYNPIIYQVIDYKFACCQTGGLKATKKKSLEGFRLHTVTTVRKSSAVLEIHEEWE

SEQ ID NO: 1193 - protein, 472 aa, homo sapiens
MKSILDGLADTTFRTITTDLLYVGSNDIQYEDIKGDMASKLGYFPQKFPLTSFRGSPFQEKMTAGDNPQLVPADQVNITEFYNKSLSSFKENEENIQCGENFMDIECFMVLNPSQQLAIAVLSLTLGTFTVLENLLVLCVILHSRSLRCRPSYHFIGSLAVADLLGSVIFVYSFIDFHVFHRKDSRNVFLFKLGGVTASFTASVGSLFLTAIDRYISIHRPLAYKRIVTRPKAVVAFCLMWTIAIVIAVLPLLGWNCEKLQSVCSDIFPHIDETYLMFWIGVTSVLLLFIVYAYMYILWKAHSHAVRMIQRGTQKSIIIHTSEDGKVQVTRPDQARMDIRLAKTLVLILVVLIICWGPLLAIMVYDVFGKMNKLIKTVFAFCSMLCLLNSTVNPIIYALRSKDLRHAFRSMFPSCEGTAQPLDNSMGDSDCLHKHANNAASVHRAAESCIKSTVKIAKVTMSVSTDTSAEAL

SEQ ID NO: 1194 - protein, 378 aa, homo sapiens
MATALPPRLQPVRGNETLREHYQYVGKLAGRLKEASEGSTLTTVLFLVICSFIVLENLMVLIAIWKNNKFHNRMYFFIGNLALCDLLAGIAYKVNILMSGKKTFSLSPTVWFLREGSMFVALGASTCSLLAIAIERHLTMIKMRPYDANKRHRVFLLIGMCWLIAFTLGALPILGWNCLHNLPDCSTILPLYSKKYIAFCISIFTAILVTIVILYARIYFLVKSSSRKVANHNNSERSMALLRTVVIVVSVFIACWSPLFILFLIDVACRVQACPILFKAQWFIVLAVLNSAMNPVIYTLASKEMRRAFFRLVCNCLVRGRGARASPIQPALDPSRSKSSSSNNSSHSPKVKEDLPHTAPSSCIMDKNAALQNGIFCN

SEQ ID NO: 1195 - protein, 380 aa, homo sapiens
MDSPIQIFRGEPGPTCAPSACLPPNSSAWFPGWAEPDSNGSAGSEDAQLEPAHISPAIPVIITAVYSVVFVVGLVGNSLVMFVIIRYTKMKTATNIYIFNLALADALVTTTMPFQSTVYLMNSWPFGDVLCKIVISIDYYNMFTSIFTLTMMSVDRYIAVCHPVKALDFRTPLKAKIINICIWLLSSSVGISAIVLGGTKVREDVDVIECSLQFPDDDYSWWDLFMKICVFIFAFVIPVLIIIVCYTLMILRLKSVRLLSGSREKDRNLRRITRLVLVVVAVFVVCWTPIHIFILVEALGSTSHSTAALSSYYFCIALGYTNSSLNPILYAFLDENFKRCFRDFCFPLKMRMERQSTSRVRNTVQDPAYLRDIDGMNKPV

SEQ ID NO: 1196 - protein, 375 aa, homo sapiens
MRSVAPSGPKMGNITADNSSMSCTIDHTIHQTLAPVVYVTVLVVGFPANCLSLYFGYLQIKARNELGVYLCNLTVADLFYICSLPFWLQYVLQHDNWSHGDLSCQVCGILLYENIYISVGFLCCISVDRYLAVAHPFRFHQFRTLKAAVGVSVVIWAKELLTSIYFLMHEEVIEDENQHRVCFEHYPIQAWQRAINYYRFLVGFLFPICLLLASYQGILRAVRRSHGTQKSRKDQIQRLVLSTVVIFLACFLPYHVLLLVRSVWEASCDFAKGVFNAYHFSLLLTSFNCVADPVLYCFVSETTHRDLARLRGACLAFLTCSRTGRAREAYPLGAPEASGKSGAQGEEPELLTKLHPAFQTPNSPGSGGFPTGRLA

SEQ ID NO: 1197 - protein, 453 aa, homo sapiens
MGTQPEPGLGARMAIHKALVMCLGLPLFLFPGAWAQGHVPPGCSQGLNPLYYNLCDRSGAWGIVLEAVAGAGIVTTFVLTIILVASLPFVQDTKKRSLLGTQVFFLLGTLGLFCLVFACVVKPDFSTCASRRFLFGVLFAICFSCLAAHVFALNFLARKNHGPRGWVIFTVALLLTLVEVIINTEWLIITLVRGSGEGGPQGNSSAGWAVASPCAIANMDFVMALIYVMLLLLGAFLGAWPALCGRYKRWRKHGVFVLLTTATSVAIWVVWIVMYTYGNKQHNSPTWDDPTLAIALAANAWAFVLFYVIPEVSQVTKSSPEQSYQGDMYPTRGVGYETILKEQKGQSMFVENKAFSMDEPVAAKRPVSPYSGYNGQLLTSVYQPTEMALMHKVPSEGAYDIILPRATANSQVMGSANSTLRAEDMYSAQSHQAATPPKDGKNSQVFRNPYVWD

SEQ ID NO: 1198 - protein, 941 aa, homo sapiens
MASPRSSGQPGPPPPPPPPPARLLLLLLLPLLLPLAPGAWGWARGAPRPPPSSPPLSIMGLMPLTKEVAKGSIGRGVLPAVELAIEQIRNESLLRPYFLDLRLYDTECDNAKGLKAFYDAIKYGPNHLMVFGGVCPSVTSIIAESLQGWNLVQLSFAATTPVLADKKKYPYFFRTVPSDNAVNPAILKLLKHYQWKRVGTLTQDVQRFSEVRNDLTGVLYGEDIEISDTESFSNDPCTSVKKLKGNDVRIILGQFDQNMAAKVFCCAYEENMYGSKYQWIIPGWYEPSWWEQVHTEANSSRCLRKNLLAAMEGYIGVDFEPLSSKQIKTISGKTPQQYEREYNNKRSGVGPSKFHGYAYDGIWVIAKTLQRAMETLHASSRHQRIQDFNYTDHTLGRIILNAMNETNFFGVTGQVVFRNGERMGTIKFTQFQDSREVKVGEYNAVADTLEIINDTIRFQGSEPPKDKTIILEQLRKISLPLYSILSALTILGMIMASAFLFFNIKNRNQKLIKMSSPYMNNLIILGGMLSYASIFLFGLDGSFVSEKTFETLCTVRTWILTVGYTTAFGAMFAKTWRVHAIFKNVKMKKKIIKDQKLLVIVGGMLLIDLCILICWQAVDPLRRTVEKYSMEPDPAGRDISIRPLLEHCENTHMTIWLGIVYAYKGLLMLFGCFLAWETRNVSIPALNDSKYIGMSVYNVGIMCIIGAAVSFLTRDQPNVQFCIVALVIIFCSTITLCLVFVPKLITLRTNPDAATQNRRFQFTQNQKKEDSKTSTSVTSVNQASTSRLEGLQSENHRLRMKITELDKDLEEVTMQLQDTPEKTTYIKQNHYQELNDILNLGNFTESTDGGKAILKNHLDQNPQLQWNTTEPSRTCKDPIEDINSPEHIQRRLSLQLPILHHAYLPSIGGVDASCVSPCVSPTASPRHRHVPPSFRVMVSGL

SEQ ID NO: 1199 - protein, 434 aa, homo sapiens
MEDLFSPSILPPAPNISVPILLGWGLNLTLGQGAPASGPPSRRVRLVFLGVILVVAVAGNTTVLCRLCGGGGPWAGPKRRKMDFLLVQLALADLYACGGTALSQLAWELLGEPRAATGDLACRFLQLLQASGRGASAHLVVLIALERRRAVRLPHGRPLPARALAALGWLLALLLALPPAFVVRGDSPSPLPPPPPPTSLQPGAPPAARAWPGERRCHGIFAPLPRWHLQVYAFYEAVAGFVAPVTVLGVACGHLLSVWWRHRPQAPAAAAPWSASPGRAPAPSALPRAKVQSLKMSLLLALLFVGCELPYFAARLAAAWSSGPAGDWEGEGLSAALRVVAMANSALNPFVYLFFQAGDCRLRRQLRKRLGSLCCAPQGGAEDEEGPRGHQALYRQRWPHPHYHHARREPLDEGGLRPPPPRPRPLPCSCESAF

SEQ ID NO: 1200 - protein, 886 aa, homo sapiens
MRGFNLLLFWGCCVMHSWEGHIRPTRKPNTKGNNCRDSTLCPAYATCTNTVDSYYCACKQGFLSSNGQNHFKDPGVRCKDIDECSQSPQPCGPNSSCKNLSGRYKCSCLDGFSSPTGNDWVPGKPGNFSCTDINECLTSSVCPEHSDCVNSMGSYSCSCQVGFISRNSTCEDVDECADPRACPEHATCNNTVGNYSCFCNPGFESSSGHLSFQGLKASCEDIDECTEMCPINSTCTNTPGSYFCTCHPGFAPSNGQLNFTDQGVECRDIDECRQDPSTCGPNSICTNALGSYSCGCIAGFHPNPEGSQKDGNFSCQRVLFKCKEDVIPDNKQIQQCQEGTAVKPAYVSFCAQINNIFSVLDKVCENKTTVVSLKNTTESFVPVLKQISTWTKFTKEETSSLATVFLESVESMTLASFWKPSANITPAVRTEYLDIESKVINKECSEENVTLDLVAKGDKMKIGCSTIEESESTETTGVAFVSFVGMESVLNERFFKDHQAPLTTSEIKLKMNSRVVGGIMTGEKKDGFSDPIIYTLENIQPKQKFERPICVSWSTDVKGGRWTSFGCVILEASETYTICSCNQMANLAVIMASGELTMDFSLYIISHVGIIISLVCLVLAIATFLLCRSIRNHNTYLHLHLCVCLLLAKTLFLAGIHKTDNKMGCAIIAGFLHYLFLACFFWMLVEAVILFLMVRNLKVVNYFSSRNIKMLHICAFGYGLPMLVVVISASVQPQGYGMHNRCWLNTETGFIWSFLGPVCTVIVINSLLLTWTLWILRQRLSSVNAEVSTLKDTRLLTFKAFAQLFILGCSWVLGIFQIGPVAGVMAYLFTIINSLQGAFIFLIHCLLNGQVREEYKRWITGKTKPSSQSQTSRILLSSMPSASKTG

SEQ ID NO: 1201 - protein, 1469 aa, homo sapiens
MARLAAVLWNLCVTAVLVTSATQGLSRAGLPFGLMRRELACEGYPIELRCPGSDVIMVENANYGRTDDKICDADPFQMENVQCYLPDAFKIMSQRCNNRTQCVVVAGSDAFPDPCPGTYKYLEVQYDCVPYIFVCPGTLQKVLEPTSTHESEHQSGAWCKDPLQAGDRIYVMPWIPYRTDTLTEYASWEDYVAARHTTTYRLPNRVDGTGFVVYDGAVFYNKERTRNIVKYDLRTRIKSGETVINTANYHDTSPYRWGGKTDIDLAVDENGLWVIYATEGNNGRLVVSQLNPYTLRFEGTWETGYDKRSASNAFMVCGVLYVLRSVYVDDDSEAAGNRVDYAFNTNANREEPVSLTFPNPYQFISSVDYNPRDNQLYVWNNYFVVRYSLEFGPPDPSAGPATSPPLSTTTTARPTPLTSTASPAATTPLRRAPLTTHPVGAINQLGPDLPPATAPVPSTRRPPAPNLHVSPELFCEPREVRRVQWPATQQGMLVERPCPKGTRGIASFQCLPALGLWNPRGPDLSNCTSPWVNQVAQKIKSGENAANIASELARHTRGSIYAGDVSSSVKLMEQLLDILDAQLQALRPIERESAGKNYNKMHKRERTCKDYIKAVVETVDNLLRPEALESWKDMNATEQVHTATMLLDVLEEGAFLLADNVREPARFLAAKENVVLEVTVLNTEGQVQELVFPQEEYPRKNSIQLSAKTIKQNSRNGVVKVVFILYNNLGLFLSTENATVKLAGEAGPGGPGGASLVVNSQVIAASINKESSRVFLMDPVIFTVAHLEDKNHFNANCSFWNYSERSMLGYWSTQGCRLVESNKTHTTCACSHLTNFAVLMAHREIYQGRINELLLSVITWVGIVISLVCLAICISTFCFLRGLQTDRNTIHKNLCINLFLAELLFLVGIDKTQYEIACPIFAGLLHYFFLAAFSWLCLEGVHLYLLLVEVFESEYSRTKYYYLGGYCFPALVVGIAAAIDYRSYGTEKACWLRVDNYFIWSFIGPVSFVIVVNLVFLMVTLHKMIRSSSVLKPDSSRLDNIKSWALGAIALLFLLGLTWAFGLLFINKESVVMAYLFTTFNAFQGVFIFVFHCALQKKVHKEYSKCLRHSYCCIRSPPGGTHGSLKTSAMRSNTRYYTGTQSRIRRMWNDTVRKQTESSFMAGDINSTPTLNRGTMGNHLLTNPVLQPRGGTSPYNTLIAESVGFNPSSPPVFNSPGSYREPKHPLGGREACGMDTLPLNGNFNNSYSLRSGDFPPGDGGPEPPRGRNLADAAAFEKMIISELVHNNLRGSSSAAKGPPPPEPPVPPVPGGGGEEEAGGPGGADRAEIELLYKALEEPLLLPRAQSVLYQSDLDESESCTAEDGATSRPLSSPPGRDSLYASGANLRDSPSYPDSSPEGPSEALPPPPPAPPGPPEIYYTSRPPALVARNPLQGYYQVRRPSHEGYLAAPGLEGPGPDGDGQMQLVTSL

SEQ ID NO: 1202 - protein, 693 aa, homo sapiens
MTPQSLLQTTLFLLSLLFLVQGAHGRGHREDFRFCSQRNQTHRSSLHYKPTPDLRISIENSEEALTVHAPFPAAHPASRSFPDPRGLYHFCLYWNRHAGRLHLLYGKRDFLLSDKASSLLCFQHQEESLAQGPPLLATSVTSWWSPQNISLPSAASFTFSFHSPPHTAAHNASVDMCELKRDLQLLSQFLKHPQKASRRPSAAPASQQLQSLESKLTSVRFMGDMVSFEEDRINATVWKLQPTAGLQDLHIHSRQEEEQSEIMEYSVLLPRTLFQRTKGRSGEAEKRLLLVDFSSQALFQDKNSSQVLGEKVLGIVVQNTKVANLTEPVVLTFQHQLQPKNVTLQCVFWVEDPTLSSPGHWSSAGCETVRRETQTSCFCNHLTYFAVLMVSSVEVDAVHKHYLSLLSYVGCVVSALACLVTIAAYLCSRVPLPCRRKPRDYTIKVHMNLLLAVFLLDTSFLLSEPVALTGSEAGCRASAIFLHFSLLTCLSWMGLEGYNLYRLVVEVFGTYVPGYLLKLSAMGWGFPIFLVTLVALVDVDNYGPIILAVHRTPEGVIYPSMCWIRDSLVSYITNLGLFSLVFLFNMAMLATMVVQILRLRPHTQKWSHVLTLLGLSLVLGLPWALIFFSFASGTFQLVVLYLFSIITSFQGFLIFIWYWSMRLQARGGPSPLKSNSDSARLPISSGSTSSSRI

SEQ ID NO: 1203 - protein, 321 aa, homo sapiens
MNQTLNSSGTVESALNYSRGSTVHTAYLVLSSLAMFTCLCGMAGNSMVIWLLGFRMHRNPFCIYILNLAAADLLFLFSMASTLSLETQPLVNTTDKVHELMKRLMYFAYTVGLSLLTAISTQRCLSVLFPIWFKCHRPRHLSAWVCGLLWTLCLLMNGLTSSFCSKFLKFNEDRCFRVDMVQAALIMGVLTPVMTLSSLTLFVWVRRSSQQWRRQPTRLFVVVLASVLVFLICSLPLSIYWFVLYWLSLPPEMQVLCFSLSRLSSSVSSSANPVIYFLVGSRRSHRLPTRSLGTVLQQALREEPELEGGETPTVGTNEMGA

SEQ ID NO: 1204 - protein, 336 aa, homo sapiens
MGNCLHRAELSPSTENSSQLDFEDVWNSSYGVNDSFPDGDYGANLEAAAPCHSCNLLDDSALPFFILTSVLGILASSTVLFMLFRPLFRWQLCPGWPVLAQLAVGSALFSIVVPVLAPGLGSTRSSALCSLGYCVWYGSAFAQALLLGCHASLGHRLGAGQVPGLTLGLTVGIWGVAALLTLPVTLASGASGGLCTLIYSTELKALQATHTVACLAIFVLLPLGLFGAKGLKKALGMGPGPWMNILWAWFIFWWPHGVVLGLDFLVRSKLLLLSTCLAQQALDLLLNLAEALAILHCVATPLLLALFCHQATRTLLPSLPLPEGWSSHLDTLGSKS

SEQ ID NO: 1205 - protein, 874 aa, homo sapiens
MEKLLRLCCWYSWLLLFYYNFQVRGVYSRSQDHPGFQVLASASHYWPLENVDGIHELQDTTGDIVEGKVNKGIYLKEEKGVTLLYYGRYNSSCISKPEQCGPEGVTFSFFWKTQGEQSRPIPSAYGGQVISNGFKVCSSGGRGSVELYTRDNSMTWEASFSPPGPYWTHVLFTWKSKEGLKVYVNGTLSTSDPSGKVSRDYGESNVNLVIGSEQDQAKCYENGAFDEFIIWERALTPDEIAMYFTAAIGKHALLSSTLPSLFMTSTASPVMPTDAYHPIITNLTEERKTFQSPGVILSYLQNVSLSLPSKSLSEQTALNLTKTFLKAVGEILLLPGWIALSEDSAVVLSLIDTIDTVMGHVSSNLHGSTPQVTVEGSSAMAEFSVAKILPKTVNSSHYRFPAHGQSFIQIPHEAFHRHAWSTVVGLLYHSMHYYLNNIWPAHTKIAEAMHHQDCLLFATSHLISLEVSPPPTLSQNLSGSPLITVHLKHRLTRKQHSEATNSSNRVFVYCAFLDFSSGEGVWSNHGCALTRGNLTYSVCRCTHLTNFAILMQVVPLELARGHQVALSSISYVGCSLSVLCLVATLVTFAVLSSVSTIRNQRYHIHANLSFAVLVAQVLLLISFRLEPGTTPCQVMAVLLHYFFLSAFAWMLVEGLHLYSMVIKVFGSEDSKHRYYYGMGWGFPLLICIISLSFAMDSYGTSNNCWLSLASGAIWAFVAPALFVIVVNIGILIAVTRVISQISADNYKIHGDPSAFKLTAKAVAVLLPILGTSWVFGVLAVNGCAVVFQYMFATLNSLQGLFIFLFHCLLNSEVRAAFKHKTKVWSLTSSSARTSNAKPFHSDLMNGTRPGMASTKLSPWDKSSHSAHRVDLSAV

SEQ ID NO: 1206 - protein, 470 aa, homo sapiens
MDTTMEADLGATGHRPRTELDDEDSYPQGGWDTVFLVALLLLGLPANGLMAWLAGSQARHGAGTRLALLLLSLALSDFLFLAAAAFQILEIRHGGHWPLGTAACRFYYFLWGVSYSSGLFLLAALSLDRCLLALCPHWYPGHRPVRLPLWVCAGVWVLATLFSVPWLVFPEAAVWWYDLVICLDFWDSEELSLRMLEVLGGFLPFLLLLVCHVLTQATACRTCHRQQQPAACRGFARVARTILSAYVVLRLPYQLAQLLYLAFLWDVYSGYLLWEALVYSDYLILLNSCLSPFLCLMASADLRTLLRSVLSSFAAALCEERPGSFTPTEPQTQLDSEGPTLPEPMAEAQSQMDPVAQPQVNPTLQPRSDPTAQPQLNPTAQPQSDPTAQPQLNLMAQPQSDSVAQPQADTNVQTPAPAASSVPSPCDEASPTPSSHPTPGALEDPATPPASEGESPSSTPPEAAPGAGPT

SEQ ID NO: 1207 - protein, 879 aa, homo sapiens
MKMLTRLQVLTLALFSKGFLLSLGDHNFLRREIKIEGDLVLGGLFPINEKGTGTEECGRINEDRGIQRLEAMLFAIDEINKDDYLLPGVKLGVHILDTCSRDTYALEQSLEFVRASLTKVDEAEYMCPDGSYAIQENIPLLIAGVIGGSYSSVSIQVANLLRLFQIPQISYASTSAKLSDKSRYDYFARTVPPDFYQAKAMAEILRFFNWTYVSTVASEGDYGETGIEAFEQEARLRNICIATAEKVGRSNIRKSYDSVIRELLQKPNARVVVLFMRSDDSRELIAAASRANASFTWVASDGWGAQESIIKGSEHVAYGAITLELASQPVRQFDRYFQSLNPYNNHRNPWFRDFWEQKFQCSLQNKRNHRRVCDKHLAIDSSNYEQESKIMFVVNAVYAMAHALHKMQRTLCPNTTKLCDAMKILDGKKLYKDYLLKINFTAPFNPNKDADSIVKFDTFGDGMGRYNVFNFQNVGGKYSYLKVGHWAETLSLDVNSIHWSRNSVPTSQCSDPCAPNEMKNMQPGDVCCWICIPCEPYEYLADEFTCMDCGSGQWPTADLTGCYDLPEDYIRWEDAWAIGPVTIACLGFMCTCMVVTVFIKHNNTPLVKASGRELCYILLFGVGLSYCMTFFFIAKPSPVICALRRLGLGSSFAICYSALLTKTNCIARIFDGVKNGAQRPKFISPSSQVFICLGLILVQIVMVSVWLILEAPGTRRYTLAEKRETVILKCNVKDSSMLISLTYDVILVILCTVYAFKTRKCPENFNEAKFIGFTMYTTCIIWLAFLPIFYVTSSDYRVQTTTMCISVSLSGFVVLGCLFAPKVHIILFQPQKNVVTHRLHLNRFSVSGTGTTYSQSSASTYVPTVCNGREVLDSTTSSL

SEQ ID NO: 1208 - protein, 371 aa, homo sapiens
MPANFTEGSFDSSGTGQTLDSSPVACTETVTFTEVVEGKEWGSFYYSFKTEQLITLWVLFVFTIVGNSVVLFSTWRRKKKSRMTFFVTQLAITDSFTGLVNILTDINWRFTGDFTAPDLVCRVVRYLQVVLLYASTYVLVSLSIDRYHAIVYPMKFLQGEKQARVLIVIAWSLSFLFSIPTLIIFGKRTLSNGEVQCWALWPDDSYWTPYMTIVAFLVYFIPLTIISIMYGIVIRTIWIKSKTYETVISNCSDGKLCSSYNRGLISKAKIKAIKYSIIIILAFICCWSPYFLFDILDNFNLLPDTQERFYASVIIQNLPALNSAINPLIYCVFSSSISFPCREQRSQDSRMTFRERTERHEMQILSKPEFI

SEQ ID NO: 1209 - protein, 334 aa, homo sapiens
MLGIMAWNATCKNWLAAEAALEKYYLSIFYGIEFVVGVLGNTIVVYGYIFSLKNWNSSNIYLFNLSVSDLAFLCTLPMLIRSYANGNWIYGDVLCISNRYVLHANLYTSILFLTFISIDRYLIIKYPFREHLLQKKEFAILISLAIWVLVTLELLPILPLINPVITDNGTTCNDFASSGDPNYNLIYSMCLTLLGFLIPLFVMCFFYYKIALFLKQRNRQVATALPLEKPLNLVIMAVVIFSVLFTPYHVMRNVRIASRLGSWKQYQCTQVVINSFYIVTRPLAFLNSVINPVFYFLLGDHFRDMLMNQLRHNFKSLTSFSRWAHELLLSFREK

SEQ ID NO: 1210 - protein, 353 aa, homo sapiens
MEHTHAHLAANSSLSWWSPGSACGLGFVPVVYYSLLLCLGLPANILTVIILSQLVARRQKSSYNYLLALAAADILVLFFIVFVDFLLEDFILNMQMPQVPDKIIEVLEFSSIHTSIWITVPLTIDRYIAVCHPLKYHTVSYPARTRKVIVSVYITCFLTSIPYYWWPNIWTEDYISTSVHHVLIWIHCFTVYLVPCSIFFILNSIIVYKLRRKSNFRLRGYSTGKTTAILFTITSIFATLWAPRIIMILYHLYGAPIQNRWLVHIMSDIANMLALLNTAINFFLYCFISKRFRTMAAATLKAFFKCQKQPVQFYTNHNFSITSSPWISPANSHCIKMLVYQYDKNGKPIKVSP

SEQ ID NO: 1211 - protein, 479 aa, homo sapiens
MANFTPVNGSSGNQSVRLVTSSSHNRYETVEMVFIATVTGSLSLVTVVGNILVMLSIKVNRQLQTVNNYFLFSLACADLIIGAFSMNLYTVYIIKGYWPLGAVVCDLWLALDYVVSNASVMNLLIISFDRYFCVTKPLTYPARRTTKMAGLMIAAAWVLSFVLWAPAILFWQFVVGKRTVPDNQCFIQFLSNPAVTFGTAIAAFYLPVVIMTVLYIHISLASRSRVHKHRPEGPKEKKAKTLAFLKSPLMKQSVKKPPPGEAAREELRNGKLEEAPPPALPPPPRPVADKDTSNESSSGSATQNTKERPATELSTTEATTPAMPAPPLQPRALNPASRWSKIQIVTKQTGNECVTAIEIVPATPAGMRPAANVARKFASIARNQVRKKRQMAARERKVTRTIFAILLAFILTWTPYNVMVLVNTFCQSCIPDTVWSIGYWLCYVNSTINPACYALCNATFKKTFRHLLLCQYRNIGTAR

SEQ ID NO: 1212 - protein, 337 aa, homo sapiens
MNEPLDYLANASDFPDYAAAFGNCTDENIPLKMHYLPVIYGIIFLVGFPGNAVVISTYIFKMRPWKSSTIIMLNLACTDLLYLTSLPFLIHYYASGENWIFGDFMCKFIRFSFHFNLYSSILFLTCFSIFRYCVIIHPMSCFSIHKTRCAVVACAVVWIISLVAVIPMTFLITSTNRTNRSACLDLTSSDELNTIKWYNLILTATTFCLPLVIVTLCYTTIIHTLTHGLQTDSCLKQKARRLTILLLLAFYVCFLPFHILRVIRIESRLLSISCSIENQIHEAYIVSRPLAALNTFGNLLLYVVVSDNFQQAVCSTVRCKVSGNLEQAKKISYSNNP

SEQ ID NO: 1213 - protein, 328 aa, homo sapiens
MDNASFSEPWPANASGPDPALSCSNASTLAPLPAPLAVAVPVVYAVICAVGLAGNSAVLYVLLRAPRMKTVTNLFILNLAIADELFTLVLPINIADFLLRQWPFGELMCKLIVAIDQYNTFSSLYFLTVMSADRYLVVLATAESRRVAGRTYSAARAVSLAVWGIVTLVVLPFAVFARLDDEQGRRQCVLVFPQPEAFWWRASRLYTLVLGFAIPVSTICVLYTTLLCRLHAMRLDSHAKALERAKKRVTFLVVAILAVCLLCWTPYHLSTVVALTTDLPQTPLVIAISYFITSLSYANSCLNPFLYAFLDASFRRNLRQLITCRAAA

SEQ ID NO: 1214 - protein, 377 aa, homo sapiens
MSPECARAAGDAPLRSLEQANRTRFPFFSDVKGDHRLVLAAVETTVLVLIFAVSLLGNVCALVLVARRRRRGATACLVLNLFCADLLFISAIPLVLAVRWTEAWLLGPVACHLLFYVMTLSGSVTILTLAAVSLERMVCIVHLQRGVRGPGRRARAVLLALIWGYSAVAALPLCVFFRVVPQRLPGADQEISICTLIWPTIPGEISWDVSFVTLNFLVPGLVIVISYSKILQTSEHLLDARAVVTHSEITKASRKRLTVSLAYSESHQIRVSQQDFRLFRTLFLLMVSFFIMWSPIIITILLILIQNFKQDLVIWPSLFFWVVAFTFANSALNPILYNMTLCRNEWKKIFCCFWFPEKGAILTDTSVKRNDLSIISG

SEQ ID NO: 1215 - protein, 422 aa, homo sapiens
MDVLSPGQGNNTTSPPAPFETGGNTTGISDVTVSYQVITSLLLGTLIFCAVLGNACVVAAIALERSLQNVANYLIGSLAVTDLMVSVLVLPMAALYQVLNKWTLGQVTCDLFIALDVLCCTSSILHLCAIALDRYWAITDPIDYVNKRTPRRAAALISLTWLIGFLISIPPMLGWRTPEDRSDPDACTISKDHGYTIYSTFGAFYIPLLLMLVLYGRIFRAARFRIRKTVKKVEKTGADTRHGASPAPQPKKSVNGESGSRNWRLGVESKAGGALCANGAVRQGDDGAALEVIEVHRVGNSKEHLPLPSEAGPTPCAPASFERKNERNAEAKRKMALARERKTVKTLGIIMGTFILCWLPFFIVALVLPFCESSCHMPTLLGAIINWLGYSNSLLNPVIYAYFNKDFQNAFKKIIKCKFCRQ

SEQ ID NO: 1216 - protein, 1474 aa, homo sapiens
MARLAAVLWNLCVTAVLVTSATQGLSRAGLPFGLMRRELACEGYPIELRCPGSDVIMVENANYGRTDDKICDADPFQMENVQCYLPDAFKIMSQRCNNRTQCVVVAGSDAFPDPCPGTYKYLEVQYDCVPYKVEQKVFVCPGTLQKVLEPTSTHESEHQSGAWCKDPLQAGDRIYVMPWIPYRTDTLTEYASWEDYVAARHTTTYRLPNRVDGTGFVVYDGAVFYNKERTRNIVKYDLRTRIKSGETVINTANYHDTSPYRWGGKTDIDLAVDENGLWVIYATEGNNGRLVVSQLNPYTLRFEGTWETGYDKRSASNAFMVCGVLYVLRSVYVDDDSEAAGNRVDYAFNTNANREEPVSLTFPNPYQFISSVDYNPRDNQLYVWNNYFVVRYSLEFGPPDPSAGPATSPPLSTTTTARPTPLTSTASPAATTPLRRAPLTTHPVGAINQLGPDLPPATAPVPSTRRPPAPNLHVSPELFCEPREVRRVQWPATQQGMLVERPCPKGTRGIASFQCLPALGLWNPRGPDLSNCTSPWVNQVAQKIKSGENAANIASELARHTRGSIYAGDVSSSVKLMEQLLDILDAQLQALRPIERESAGKNYNKMHKRERTCKDYIKAVVETVDNLLRPEALESWKDMNATEQVHTATMLLDVLEEGAFLLADNVREPARFLAAKENVVLEVTVLNTEGQVQELVFPQEEYPRKNSIQLSAKTIKQNSRNGVVKVVFILYNNLGLFLSTENATVKLAGEAGPGGPGGASLVVNSQVIAASINKESSRVFLMDPVIFTVAHLEDKNHFNANCSFWNYSERSMLGYWSTQGCRLVESNKTHTTCACSHLTNFAVLMAHREIYQGRINELLLSVITWVGIVISLVCLAICISTFCFLRGLQTDRNTIHKNLCINLFLAELLFLVGIDKTQYEIACPIFAGLLHYFFLAAFSWLCLEGVHLYLLLVEVFESEYSRTKYYYLGGYCFPALVVGIAAAIDYRSYGTEKACWLRVDNYFIWSFIGPVSFVIVVNLVFLMVTLHKMIRSSSVLKPDSSRLDNIKSWALGAIALLFLLGLTWAFGLLFINKESVVMAYLFTTFNAFQGVFIFVFHCALQKKVHKEYSKCLRHSYCCIRSPPGGTHGSLKTSAMRSNTRYYTGTQSRIRRMWNDTVRKQTESSFMAGDINSTPTLNRGTMGNHLLTNPVLQPRGGTSPYNTLIAESVGFNPSSPPVFNSPGSYREPKHPLGGREACGMDTLPLNGNFNNSYSLRSGDFPPGDGGPEPPRGRNLADAAAFEKMIISELVHNNLRGSSSAAKGPPPPEPPVPPVPGGGGEEEAGGPGGADRAEIELLYKALEEPLLLPRAQSVLYQSDLDESESCTAEDGATSRPLSSPPGRDSLYASGANLRDSPSYPDSSPEGPSEALPPPPPAPPGPPEIYYTSRPPALVARNPLQGYYQVRRPSHEGYLAAPGLEGPGPDGDGQMQLVTSL

SEQ ID NO: 1217 - protein, 451 aa, homo sapiens
MESSPIPQSSGNSSTLGRVPQTPGPSTASGVPEVGLRDVASESVALFFMLLLDLTAVAGNAAVMAVIAKTPALRKFVFVFHLCLVDLLAALTLMPLAMLSSSALFDHALFGEVACRLYLFLSVCFVSLAILSVSAINVERYYYVVHPMRYEVRMTLGLVASVLVGVWVKALAMASVPVLGRVSWEEGAPSVPPGCSLQWSHSAYCQLFVVVFAVLYFLLPLLLILVVYCSMFRVARVAAMQHGPLPTWMETPRQRSESLSSRSTMVTSSGAPQTTPHRTFGGGKAAVVLLAVGGQFLLCWLPYFSFHLYVALSAQPISTGQVESVVTWIGYFCFTSNPFFYGCLNRQIRGELSKQFVCFFKPAPEEELRLPSREGSIEENFLQFLQGTGCPSESWVSRPLPSPKQEPPAVDFRIPGQIAEETSEFLEQQLTSDIIMSDSYLRPAASPRLES

SEQ ID NO: 1218 - protein, 419 aa, homo sapiens
MLAAAFADSNSSSMNVSFAHLHFAGGYLPSDSQDWRTIIPALLVAVCLVGFVGNLCVIGILLHNAWKGKPSMIHSLILNLSLADLSLLLFSAPIRATAYSKSVWDLGWFVCKSSDWFIHTCMAAKSLTIVVVAKVCFMYASDPAKQVSIHNYTIWSVLVAIWTVASLLPLPEWFFSTIRHHEGVEMCLVDVPAVAEEFMSMFGKLYPLLAFGLPLFFASFYFWRAYDQCKKRGTKTQNLRNQIRSKQVTVMLLSIAIISALLWLPEWVAWLWVWHLKAAGPAPPQGFIALSQVLMFSISSANPLIFLVMSEEFREGLKGVWKWMITKKPPTVSESQETPAGNSEGLPDKVPSPESPASIPEKEKPSSPSSGKGKTEKAEIPILPDVEQFWHERDTVPSVQDNDPIPWEHEDQETGEGVK

SEQ ID NO: 1219 - protein, 423 aa, homo sapiens
MDRRMWGAHVFCVLSPLPTVLGHMHPECDFITQLREDESACLQAAEEMPNTTLGCPATWDGLLCWPTAGSGEWVTLPCPDFFSHFSSESGAVKRDCTITGWSEPFPPYPVACPVPLELLAEEESYFSTVKIIYTVGHSISIVALFVAITILVALRRLHCPRNYVHTQLFTTFILKAGAVFLKDAALFHSDDTDHCSFSTVLCKVSVAASHFATMTNFSWLLAEAVYLNCLLASTSPSSRRAFWWLVLAGWGLPVLFTGTWVSCKLAFEDIACWDLDDTSPYWWIIKGPIVLSVGVNFGLFLNIIRILVRKLEPAQGSLHTQSQYWRLSKSTLFLIPLFGIHYIIFNFLPDNAGLGIRLPLELGLGSFQGFIVAILYCFLNQEVRTEISRKWHGHDPELLPAWRTRAKWTTPSRSAAKVLTSMC

SEQ ID NO: 1220 - protein, 3080 aa, homo sapiens
MKEHIIYQKLYGLILMSSFIFLSDTLSLKGKKLDFFGRGDTYVSLIDTIPELSRFTACIDLVFMDDNSRYWMAFSYITNNALLGREDIDLGLAGDHQQLILYRLGKTFSIRHHLASFQWHTICLIWDGVKGKLELFLNKERILEVTDQPHNLTPHGTLFLGHFLKNESSEVKSMMRSFPGSLYYFQLWDHILENEEFMKCLDGNIVSWEEDVWLVNKIIPTVDRTLRCFVPENMTIQEKSTTVSQQIDMTTPSQITGVKPQNTAHSSTLLSQSIPIFATDYTTISYSNTTSPPLETMTAQKILKTLVDETATFAVDVLSTSSAISLPTQSISIDNTTNSMKKTKSPSSESTKTTKMVEAMATEIFQPPTPSNFLSTSRFTKNSVVSTTSAIKSQSAVTKTTSLFSTIESTSMSTTPCLKQKSTNTGALPISTAGQEFIESTAAGTVPWFTVEKTSPASTHVGTASSFPPEPVLISTAAPVDSVFPRNQTAFPLATTDMKIAFTVHSLTLPTRLIETTPAPRTAETELTSTNFQDVSLPRVEDAMSTSMSKETSSKTFSFLTSFSFTGTESVQTVIDAEATRTALTPEITLASTVAETMLSSTITGRVYTQNTPTADGHLLTLMSTRSASTSKAPESGPTSTTDEAAHLFSSNETIWTSRPDQALLASMNTTTILTFVPNENFTSAFHENTTYTEYLSATTNITPLKASPEGKGTTANDATTARYTTAVSKLTSPWFANFSIVSGTTSITNMPEFKLTTLLLKTIPMSTKPANELPLTPRETVVPSVDIISTLACIQPNFSTEESASETTQTEINGAIVFGGTTTPVPKSATTQRLNATVTRKEATSHYLMRKSTIAAVAEVSPFSTMLEVTDESAQRVTASVTVSSFPDIEKLSTPLDNKTATTEVRESWLLTKLVKTTPRSSYNEMTEMFNFNHTYVAHWTSETSEGISAGSPTSGSTHIFGEPLGASTTRISETSFSTTPTDRTATSLSDGILPPQPTAAHSSATPVPVTHMFSLPVNGSSVVAEETEVTMSEPSTLARAFSTSVLSDVSNLSSTTMTTALVPPLDQTASTTIVIVPTHGDLIRTTSEATVISVRKTSMAVPSLTETPFHSLRLSTPVTAKAETTLFSTSVDTVTPSTHTLVCSKPPPDNIPPASSTHVISTTSTPEATQPISQVEETSTYALSFPYTFSGGGVVASLATGTTETSVVDETTPSHISANKLTTSVNSHISSSATYRVHTPVSIQLVTSTSVLSSDKDQMTISLGKTPRTMEVTEMSPSKNSFISYSRGTPSLEMTDTGFPETTKISSHQTHSPSEIPLGTPSDGNLASSPTSGSTQITPTLTSSNTVGVHIPEMSTSLGKTALPSQALTITTFLCPEKESTSALPAYTPRTVEMIVNSTYVTHSVSYGQDTSFVDTTTSSSTRISNPMDINTTFSHLHSLRTQPEVTSVASFISESTQTFPESLSLSTAGLYNDGFTVLSDRITTAFSVPNVPTMLPRESSMATSTPIYQMSSLPVNVTAFTSKKVSDTPPIVITKSSKTMHPGCLKSPCTATSGPMSEMSSIPVNNSAFTPATVSSDTSTRVGLFSTLLSSVTPRTTMTMQTSTLDVTPVIYAGATSKNKMVSSAFTTEMIEAPSRITPTTFLSPTEPTLPFVKTVPTTIMAGIVTPFVGTTAFSPLSSKSTGAISSIPKTTFSPFLSATQQSSQADEATTLGILSGITNRSLSTVNSGTGVALTDTYSRITVPENMLSPTHADSLHTSFNIQVSPSLTSFKSASGPTKNVKTTTNCFSSNTRKMTSLLEKTSLTNYATSLNTPVSYPPWTPSSATLPSLTSFVYSPHSTEAEISTPKTSPPPTSQMVEFPVLGTRMTSSNTQPLLMTSWNIPTAEGSQFPISTTINVPTSNEMETETLHLVPGPLSTFTASQTGLVSKDVMAMSSIPMSGILPNHGLSENPSLSTSLRAITSTLADVKHTFEKMTTSVTPGTTLPSILSGATSGSVISKSPILTWLLSSLPSGSPPATVSNAPHVMTSSTVEVSKSTFLTSDMISAHPFTNLTTLPSATMSTILTRTIPTPTLGGITTGFPTSLPMSINVTDDIVYISTHPEASSRTTITANPRTVSHPSSFSRKTMSPSTTDHTLSVGAMPLPSSTITSSWNRIPTASSPSTLIIPKPTLDSLLNIMTTTSTVPGASFPLISTGVTYPFTATVSSPISSFFETTWLDSTPSFLSTEASTSPTATKSTVSFYNVEMSFSVFVEEPRIPITSVINEFTENSLNSIFQNSEFSLATLETQIKSRDISEEEMVMDRAILEQREGQEMATISYVPYSCVCQVIIKASSSLASSELMRKIKSKIHGNFTHGNFTQDQLTLLVNCEHVAVKKLEPGNCKADETASKYKGTYKWLLTNPTETAQTRCIKNEDGNATRFCSISINTGKSQWEKPKFKQCKLLQELPDKIVDLANITISDENAEDVAEHILNLINESPALGKEETKIIVSKISDISQCDEISMNLTHVMLQIINVVLEKQNNSASDLHEISNEILRIIERTGHKMEFSGQIANLTVAGLALAVLRGDHTFDGMAFSIHSYEEGTDPEIFLGNVPVGGILASIYLPKSLTERIPLSNLQTILFNFFGQTSLFKTKNVTKALTTYVVSASISDDMFIQNLADPVVITLQHIGGNQNYGQVHCAFWDFENNNGLGGWNSSGCKVKETNVNYTICQCDHLTHFGVLMDLSRSTVDSVNEQILALITYTGCGISSIFLGVAVVTYIAFHKLRKDYPAKILINLCTALLMLNLVFLINSWLSSFQKVGVCITAAVALHYFLLVSFTWMGLEAVHMYLALVKVFNIYIPNYILKFCLVGWGIPAIMVAITVSVKKDLYGTLSPTTPFCWIKDDSIFYISVVAYFCLIFLMNLSMFCTVLVQLNSVKSQIQKTRRKMILHDLKGTMSLTFLLGLTWGFAFFAWGPMRNFFLYLFAIFNTLQGFFIFVFHCVMKESVREQWQIHLCCGWLRLDNSSDGSSRCQIKVGYKQEGLKKIFEHKLLTPSLKSTATSSTFKSLGSAQGTPSEISFPNDDFDKDPYCSSP

SEQ ID NO: 1221 - protein, 1321 aa, homo sapiens
MEPPGRRRGRAQPPLLLPLSLLALLALLGGGGGGGAAALPAGCKHDGRPRGAGRAAGAAEGKVVCSSLELAQVLPPDTLPNRTVTLILSNNKISELKNGSFSGLSLLERLDLRNNLISSIDPGAFWGLSSLKRLDLTNNRIGCLNADIFRGLTNLVRLNLSGNLFSSLSQGTFDYLASLRSLEFQTEYLLCDCNILWMHRWVKEKNITVRDTRCVYPKSLQAQPVTGVKQELLTCDPPLELPSFYMTPSHRQVVFEGDSLPFQCMASYIDQDMQVLWYQDGRIVETDESQGIFVEKNMIHNCSLIASALTISNIQAGSTGNWGCHVQTKRGNNTRTVDIVVLESSAQYCPPERVVNNKGDFRWPRTLAGITAYLQCTRNTHGSGIYPGNPQDERKAWRRCDRGGFWADDDYSRCQYANDVTRVLYMFNQMPLNLTNAVATARQLLAYTVEAANFSDKMDVIFVAEMIEKFGRFTKEEKSKELGDVMVDIASNIMLADERVLWLAQREAKACSRIVQCLQRIATYRLAGGAHVYSTYSPNIALEAYVIKSTGFTGMTCTVFQKVAASDRTGLSDYGRRDPEGNLDKQLSFKCNVSNTFSSLALKNTIVEASIQLPPSLFSPKQKRELRPTDDSLYKLQLIAFRNGKLFPATGNSTNLADDGKRRTVVTPVILTKIDGVNVDTHHIPVNVTLRRIAHGADAVAARWDFDLLNGQGGWKSDGCHILYSDENITTIQCYSLSNYAVLMDLTGSELYTQAASLLHPVVYTTAIILLLCLLAVIVSYIYHHSLIRISLKSWHMLVNLCFHIFLTCVVFVGGITQTRNASICQAVGIILHYSTLATVLWVGVTARNIYKQVTKKAKRCQDPDEPPPPPRPMLRFYLIGGGIPIIVCGITAAANIKNYGSRPNAPYCWMAWEPSLGAFYGPASFITFVNCMYFLSIFIQLKRHPERKYELKEPTEEQQRLAANENGEINHQDSMSLSLISTSALENEHTFHSQLLGASLTLLLYVALWMFGALAVSLYYPLDLVFSFVFGATSLSFSAFFVVHHCVNREDVRLAWIMTCCPGRSSYSVQVNVQPPNSNGTNGEAPKCPNSSAESSCTNKSASSFKNSSQGCKLTNLQAAAAQCHANSLPLNSTPQLDNSLTEHSMDNDIKMHVAPLEVQFRTNVHSSRHHKNRSKGHRASRLTVLREYAYDVPTSVEGSVQNGLPKSRLGNNEGHSRSRRAYLAYRERQYNPPQQDSSDACSTLPKSSRNFEKPVSTTSKKDALRKPAVVELENQQKSYGLNLAIQNGPIKSNGQEGPLLGTDSTGNVRTGLWKHETTV

SEQ ID NO: 1222 - protein, 910 aa, homo sapiens
MKVGVLWLISFFTFTDGHGGFLGKNDGIKTKKELIVNKKKHLGPVEEYQLLLQVTYRDSKEKRDLRNFLKLLKPPLLWSHGLIRIIRAKATTDCNSLNGVLQCTCEDSYTWFPPSCLDPQNCYLHTAGALPSCECHLNNLSQSVNFCERTKIWGTFKINERFTNDLLNSSSAIYSKYANGIEIQLKKAYERIQGFESVQVTQFRNGSIVAGYEVVGSSSASELLSAIEHVAEKAKTALHKLFPLEDGSFRVFGKAQCNDIVFGFGSKDDEYTLPCSSGYRGNITAKCESSGWQVIRETCVLSLLEELNKNFSMIVGNATEAAVSSFVQNLSVIIRQNPSTTVGNLASVVSILSNISSLSLASHFRVSNSTMEDVISIADNILNSASVTNWTVLLREEKYASSRLLETLENISTLVPPTALPLNFSRKFIDWKGIPVNKSQLKRGYSYQIKMCPQNTSIPIRGRVLIGSDQFQRSLPETIISMASLTLGNILPVSKNGNAQVNGPVISTVIQNYSINEVFLFFSKIESNLSQPHCVFWDFSHLQWNDAGCHLVNETQDIVTCQCTHLTSFSILMSPFVPSTIFPVVKWITYVGLGISIGSLILCLIIEALFWKQIKKSQTSHTRRICMVNIALSLLIADVWFIVGATVDTTVNPSGVCTAAVFFTHFFYLSLFFWMLMLGILLAYRIILVFHHMAQHLMMAVGFCLGYGCPLIISVITIAVTQPSNTYKRKDVCWLNWSNGSKPLLAFVVPALAIVAVNFVVVLLVLTKLWRPTVGERLSRDDKATIIRVGKSLLILTPLLGLTWGFGIGTIVDSQNLAWHVIFALLNAFQGFFILCFGILLDSKLRQLLFNKLSALSSWKQTEKQNSSDLSAKPKFSKPFNPLQNKGHYAFSHTGDSSDNIMLTQFVSNE

SEQ ID NO: 1223 - protein, 398 aa, homo sapiens
MHTVATSGPNASWGAPANASGCPGCGANASDGPVPSPRAVDAWLVPLFFAALMLLGLVGNSLVIYVICRHKPMRTVTNFYIANLAATDVTFLLCCVPFTALLYPLPGWVLGDFMCKFVNYIQQVSVQATCATLTAMSVDRWYVTVFPLRALHRRTPRLALAVSLSIWVGSAAVSAPVLALHRLSPGPRAYCSEAFPSRALERAFALYNLLALYLLPLLATCACYAAMLRHLGRVAVRPAPADSALQGQVLAERAGAVRAKVSRLVAAVVLLFAACWGPIQLFLVLQALGPAGSWHPRSYAAYALKTWAHCMSYSNSALNPLLYAFLGSHFRQAFRRVCPCAPRRPRRPRRPGPSDPAAPHAELLRLGSHPAPARAQKPGSSGLAARGLCVLGEDNAPL

SEQ ID NO: 1224 - protein, 915 aa, homo sapiens
MGRPRLTLVCQVSIIISARDLSMNNLTELQPGLFHHLRFLEELRLSGNHLSHIPGQAFSGLYSLKILMLQNNQLGGIPAEALWELPSLQSLRLDANLISLVPERSFEGLSSLRHLWLDDNALTEIPVRALNNLPALQAMTLALNRISHIPDYAFQNLTSLVVLHLHNNRIQHLGTHSFEGLHNLETLDLNYNKLQEFPVAIRTLGRLQELGFHNNNIKAIPEKAFMGNPLLQTIHFYDNPIQFVGRSAFQYLPKLHTLSLNGAMDIQEFPDLKGTTSLEILTLTRAGIRLLPSGMCQQLPRLRVLELSHNQIEELPSLHRCQKLEEIGLQHNRIWEIGADTFSQLSSLQALDLSWNAIRSIHPEAFSTLHSLVKLDLTDNQLTTLPLAGLGGLMHLKLKGNLALSQAFSKDSFPKLRILEVPYAYQCCPYGMCASFFKASGQWEAEDLHLDDEESSKRPLGLLARQAENHYDQDLDELQLEMEDSKPHPSVQCSPTPGPFKPCEYLFESWGIRLAVWAIVLLSVLCNGLVLLTVFAGGPVPLPPVKFVVGAIAGANTLTGISCGLLASVDALTFGQFSEYGARWETGLGCRATGFLAVLGSEASVLLLTLAAVQCSVSVSCVRAYGKSPSLGSVRAGVLGCLALAGLAAALPLASVGEYGASPLCLPYAPPEGQPAALGFTVALVMMNSFCFLVVAGAYIKLYCDLPRGDFEAVWDCAMVRHVAWLIFADGLLYCPVAFLSFASMLGLFPVTPEAVKSVLLVVLPLPACLNPLLYLLFNPHFRDDLRRLRPRAGDSGPLAYAAAGELEKSSCDSTQALVAFSDVDLILEASEAGRPPGLETYGFPSVTLISCQQPGAPRLEGSHCVEPEGNHFGNPQPSMDGELLLRAEGSTPAGGGLSGGGGFQPSGLAFASHV

SEQ ID NO: 1225 - protein, 372 aa, homo sapiens
MEPAPSAGAELQPPLFANASDAYPSACPSAGANASGPPGARSASSLALAIAITALYSAVCAVGLLGNVLVMFGIVRYTKMKTATNIYIFNLALADALATSTLPFQSAKYLMETWPFGELLCKAVLSIDYYNMFTSIFTLTMMSVDRYIAVCHPVKALDFRTPAKAKLINICIWVLASGVGVPIMVMAVTRPRDGAVVCMLQFPSPSWYWDTVTKICVFLFAFVVPILIITVCYGLMLLRLRSVRLLSGSKEKDRSLRRITRMVLVVVGAFVVCWAPIHIFVIVWTLVDIDRRDPLVVAALHLCIALGYANSSLNPVLYAFLDENFKRCFRQLCRKPCGRPDPSSFSRAREATARERVTACTPSDGPGGGAAA

SEQ ID NO: 1226 - protein, 764 aa, homo sapiens
MRPADLLQLVLLLDLPRDLGGMGCSSPPCECHQEEDFRVTCKDIQRIPSLPPSTQTLKLIETHLRTIPSHAFSNLPNISRIYVSIDVTLQQLESHSFYNLSKVTHIEIRNTRNLTYIDPDALKELPLLKFLGIFNTGLKMFPDLTKVYSTDIFFILEITDNPYMTSIPVNAFQGLCNETLTLKLYNNGFTSVQGYAFNGTKLDAVYLNKNKYLTVIDKDAFGGVYSGPSLLDVSQTSVTALPSKGLEHLKELIARNTWTLKKLPLSLSFLHLTRADLSYPSHCCAFKNQKKIRGILESLMCNESSMQSLRQRKSVNALNSPLHQEYEENLGDSIVGYKEKSKFQDTHNNAHYYVFFEEQEDEIIGFGQELKNPQEETLQAFDSHYDYTICGDSEDMVCTPKSDEFNPCEDIMGYKFLRIVVWFVSLLALLGNVFVLLILLTSHYKLNVPRFLMCNLAFADFCMGMYLLLIASVDLYTHSEYYNHAIDWQTGPGCNTAGFFTVFASELSVYTLTVITLERWYAITFAMRLDRKIRLRHACAIMVGGWVCCFLLALLPLVGISSYAKVSICLPMDTETPLALAYIVFVLTLNIVAFVIVCCCYVKIYITVRNPQYNPGDKDTKIAKRMAVLIFTDFICMAPISFYALSAILNKPLITVSNSKILLVLFYPLNSCANPFLYAIFTKAFQRDVFILLSKFGICKRQAQAYRGQRVPPKNSTDIQVQKVTHEMRQGLHNMEDVYELIENSHLTPKKQGQISEEYMQTVL

SEQ ID NO: 1227 - protein, 872 aa, homo sapiens [sequence omitted]

SEQ ID NO: 1228 - protein, 344 aa, homo sapiens
MANYTLAPEDEYDVLIEGELESDEAEQCDKYDAQALSAQLVPSLCSAVFVIGVLDNLLVVLILVKYKGLKRVENIYLLNLAVSNLCFLLTLPFWAHAGGDPMCKILIGLYFVGLYSETFFNCLLTVQRYLVFLHKGNFFSARRRVPCGIITSVLAWVTAILATLPEFVVYKPQMEDQKYKCAFSRTPFLPADETFWKHFLTLKMNISVLVLPLFIFTFLYVQMRKTLRFREQRYSLFKLVFAIMVVFLLMWAPYNIAFFLSTFKEHFSLSDCKSSYNLDKSVHITKLIATTHCCINPLLYAFLDGTFSKYLCRCFHLRSNTPLQPRGQSAQGTSREEPDHSTEV

SEQ ID NO: 1229 - protein, 462 aa, homo sapiens
MASPALAAALAVAAAAGPNASGAGERGSGGVANASGASWGPPRGQYSAGAVAGLAAVVGFLIVFTVVGNVLVVIAVLTSRALRAPQNLFLVSLASADILVATLVMPFSLANELMAYWYFGQVWCGVYLALDVLFCTSSIVHLCAISLDRYWSVTQAVEYNLKRTPRRVKATIVAVWLISAVISFPPLVSLYRQPDGAAYPQCGLNDETWYILSSCIGSFFAPCLIMGLVYARIYRVAKLRTRTLSEKRAPVGPDGASPTTENGLGAAAGAGENGHCAPPPADVEPDESSAAAERRRRRGALRRGGRRRAGAEGGAGGADGQGAGPGAAESGALTASRSPGPGGRLSRASSRSVEFFLSRRRRARSSVCRRKVAQAREKRFTFVLAVVMGVFVLCWFPFFFSYSLYGICREACQVPGPLFKFFFWIGYCNSSLNPVIYTVFNQDFRRSFKHILFRRRRRGFRQ

SEQ ID NO: 1230 - protein, 402 aa, homo sapiens
MYSGNRSGGHGYWDGGGAAGAEGPAPAGTLSPAPLFSPGTYERLALLLGSIGLLGVGNNLLVLVLYYKFQRLRTPTHLLLVNISLSDLLVSLFGVTFTFVSCLRNGWVWDTVGCVWDGFSGSLFGIVSIATLTVLAYERYIRVVHARVINFSWAWRAITYIWLYSLAWAGAPLLGWNRYILDVHGLGCTVDWKSKDANDSSFVLFLFLGCLVVPLGVIAHCYGHILYSIRMLRCVEDLQTIQVIKILKYEKKLAKMCFLMIFTFLVCWMPYIVICFLVVNGHGHLVTPTISIVSYLFAKSNTVYNPVIYVFMIRKFRRSLLQLLCLRLLRCQRPAKDLPAAGSEMQIRPIVMSQKDGDRPKKKVTFNSSSIIFIITSDESLSVDDSDKTNGSKVDVIQVRPL

SEQ ID NO: 1231 - protein, 1221 aa, homo sapiens
MMFRSDRMWSCHWKWKPSPLLFLFALYIMCVPHSVWGCANCRVVLSNPSGTFTSPCYPNDYPNSQACMWTLRAPTGYIIQITFNDFDIEEAPNCIYDSLSLDNGESQTKFCGATAKGLSFNSSANEMHVSFSSDFSIQKKGFNASYIRVAVSLRNQKVILPQTSDAYQVSVAKSISIPELSAFTLCFEATKVGHEDSDWTAFSYSNASFTQLLSFGKAKSGYFLSISDSKCLLNNALPVKEKEDIFAESFEQLCLVWNNSLGSIGVNFKRNYETVPCDSTISKVIPGNGKLLLGSNQNEIVSLKGDIYNFRLWNFTMNAKILSNLSCNVKGNVVDWQNDFWNIPNLALKAESNLSCGSYLIPLPAAELASCADLGTLCQATVNSPSTTPPTVTTNMPVTNRIDKQRNDGIIYRISVVIQNILRHPEVKVQSKVAEWLNSTFQNWNYTVYVVNISFHLSAGEDKIKVKRSLEDEPRLVLWALLVYNATNNTNLEGKIIQQKLLKNNESLDEGLRLHTVNVRQLGHCLAMEEPKGYYWPSIQPSEYVLPCPDKPGFSASRICFYNATNPLVTYWGPVDISNCLKEANEVANQILNLTADGQNLTSANITNIVEQVKRIVNKEENIDITLGSTLMNIFSNILSSSDSDLLESSSEALKTIDELAFKIDLNSTSHVNITTRNLALSVSSLLPGTNAISNFSIGLPSNNESYFQMDFESGQVDPLASVILPPNLLENLSPEDSVLVRRAQFTFFNKTGLFQDVGPQRKTLVSYVMACSIGNITIQNLKDPVQIKIKHTRTQEVHHPICAFWDLNKNKSFGGWNTSGCVAHRDSDASETVCLCNHFTHFGVLMDLPRSASQLDARNTKVLTFISYIGCGISAIFSAATLLTYVAFEKLRRDYPSKILMNLSTALLFLNLLFLLDGWITSFNVDGLCIAVAVLLHFFLLATFTWMGLEAIHMYIALVKVFNTYIRRYILKFCIIGWGLPALVVSVVLASRNNNEVYGKESYGKEKGDEFCWIQDPVIFYVTCAGYFGVMFFLNIAMFIVVMVQICGRNGKRSNRTLREEVLRNLRSVVSLTFLLGMTWGFAFFAWGPLNIPFMYLFSIFNSLQGLFIFIFHCAMKENVQKQWRRHLCCGRFRLADNSDWSKTATNIIKKSSDNLGKSLSSSSIGSNSTYLTSKSKSSSTTYFKRNSHTDNVSYEHSFNKSGSLRQCFHGQVLVKTGPC

SEQ ID NO: 1232 - protein, 351 aa, homo sapiens
MAVSSEQHELSHFKRTQTKKEKFNCSEYGNRSCPENERSLGVRVAMYSFMAGSIFITIFGNLAMIISISYFKQLHTPTNFLILSMAITDFLLGFTIMPYSMIRSVENCWYFGLTFCKIYYSFDLMLSITSIFHLCSVAIDRFYAICYPLLYSTKITIPVIKRLLLLCWSVPGAFAFGVVFSEAYADGIEGYDILVACSSSCPVMFNKLWGTTLFMAGFFTPGSMMVGIYGKIFAVSRKHAHAINNLRENQNNQVKKDKKAAKTLGIVIGVFLLCWFPCFFTILLDPFLNFSTPVVLFDALTWFGYFNSTCNPLIYGFFYPWFRRALKYILLGKIFSSCFHNTILCMQKESE

SEQ ID NO: 1233 - protein, 731 aa, homo sapiens
MSLFLSNLSTNDSSLWKENHNSTDLLNPPGTLNIYLFCLTCLMTFAALVGSIYSLISLLKMQNRTVVSMLVASWSVDDLMSVLSVTIFMFLQWPNEVPGYFQFLCTTSALMYLCQGLSSNLKATLLVSYNFYTMHRGVGSQTASRRSGQVLGVVLTVWAASLLLSALPLCGWGAFVRTPWGCLVDCSSSYVLFLSIVYALAFGLLVGLSVPLTHRLLCSEEPPRLHSNYQEISRGASIPGTPPTAGRVVSLSPEDAPGPSLRRSGGCSPSSDTVFGPGAPAAAGAEACRRENRGTLYGTRSFTVSVAQKRFALILALTKVVLWLPMMMHMVVQNVVGFQSLPLETFSFLLTLLATTVTPVFVLSKRWTHLPCGCIINCRQNAYAVASDGKKIKRKGFEFNLSFQKSYGIYKIAHEDYYDDDENSIFYHNLMNSECETTKDPQRDNRNIFNAIKVEISTTPSLDSSTQRGINKCTNTDITEAKQDSNNKKDAFSDKTGGDINYEETTFSEGPERRLSHEESQKPDLSDWEWCRSKSERTPRQRSGYALAIPLCAFQGTVSLHAPTGKTLSLSTYEVSAEGQKITPASKKIEVYRSKSVGHEPNSEDSSSTFVDTSVKIHLEVLEICDNEEALDTVSIISNISQSSTQVRSPSLRYSRKENRFVSCDLGETASYSLFLPTSNPDGDINISIPDTVEAHRQNSKRQHQERDGYQEEIQLLNKAYRKREEESKGS

SEQ ID NO: 1234 - protein, 311 aa, homo sapiens
MEPREAGQHVGAANGAQEDVAFNLIILSLTEGLGLGGLLGNGAVLWLLSSNVYRNPFAIYLLDVACADLIFLGCHMVAIVPDLLQGRLDFPGFVQTSLATLRFFCYIVGLSLLAAVSVEQCLAALFPAWYSCRRPRHLTTCVCALTWALCLLLHLLLSGACTQFFGEPSRHLCRTLWLVAAVLLALLCCTMCGASLMLLLRVERGPQRPPPRGFPGLILLTVLLFLFCGLPFGIYWLSRNLLWYIPHYFYHFSFLMAAVHCAAKPVVYFCLGSAQGRRLPLRLVLQRALGDEAELGAVRETSRRGLVDIAA

SEQ ID NO: 1235 - protein, 757 aa, homo sapiens
MTSGSVFFYILIFGKYFSHGGGQDVKCSLGYFPCGNITKCLPQLLHCNGVDDCGNQADEDNCGDNNGWSLQFDKYFASYYKMTSQYPFEAETPECLVGSVPVQCLCQGLELDCDETNLRAVPSVSSNVTAMSLQWNLIRKLPPDCFKNYHDLQKLYLQNNKITSISIYAFRGLNSLTKLYLSHNRITFLKPGVFEDLHRLEWLIIEDNHLSRISPPTFYGLNSLILLVLMNNVLTRLPDKPLCQHMPRLHWLDLEGNHIHNLRNLTFISCSNLTVLVMRKNKINHLNENTFAPLQKLDELDLGSNKIENLPPLIFKDLKELSQLNLSYNPIQKIQANQFDYLVKLKSLSLEGIEISNIQQRMFRPLMNLSHIYFKKFQYCGYAPHVRSCKPNTDGISSLENLLASIIQRVFVWVVSAVTCFGNIFVICMRPYIRSENKLYAMSIISLCCADCLMGIYLFVIGGFDLKFRGEYNKHAQLWMESTHCQLVGSLAILSTEVSVLLLTFLTLEKYICIVYPFRCVRPGKCRTITVLILIWITGFIVAFIPLSNKEFFKNYYGTNGVCFPLHSEDTESIGAQIYSVAIFLGINLAAFIIIVFSYGSMFYSVHQSAITATEIRNQVKKEMILAKRFFFIVFTDALCWIPIFVVKFLSLLQVEIPGTITSWVVIFILPINSALNPILYTLTTRPFKEMIHRFWYNYRQRKSMDSKGQKTYAPSFIWVEMWPLQEMPPELMKPDLFTYPCEMSLISQSTRLNSYS

SEQ ID NO: 1236 - protein, 422 aa, homo sapiens
MSVGAMKKGVGRAVGLGGGSGCQATEEDPLPNCGACAPGQGGRRWRLPQPAWVEGSSARLWEQATGTGWMDLEASLLPTGPNASNTSDGPDNLTSAGSPPRTGSISYINIIMPSVFGTICLLGIIGNSTVIFAVVKKSKLHWCNNVPDIFIINLSVVDLLFLLGMPFMIHQLMGNGVWHFGETMCTLITAMDANSQFTSTYILTAMAIDRYLATVHPISSTKFRKPSVATLVICLLWALSFISITPVWLYARLIPFPGGAVGCGIRLPNPDTDLYWFTLYQFFLAFALPFVVITAAYVRILQRMTSSVAPASQRSIRLRTKRVTRTAIAICLVFFVCWAPYYVLQLTQLSISRPTLTFVYLYNAAISLGYANSCLNPFVYIVLCETFRKRLVLSVKPAAQGQLRAVSNAQTADEERTESKGT

SEQ ID NO: 1237 - protein, 400 aa, homo sapiens
MASLSQLSGHLNYTCGAENSTGASQARPHAYYALSYCALILAIVFGNGLVCMAVLKERALQTTTNYLVVSLAVADLLVATLVMPWVVYLEVTGGVWNFSRICCDVFVTLDVMMCTASILNLCAISIDRYTAVVMPVHYQHGTGQSSCRRVALMITAVWVLAFAVSCPLLFGFNTTGDPTVCSISNPDFVIYSSVVSFYLPFGVTVLVYARIYVVLKQRRRKRILTRQNSQCNSVRPGFPQQTLSPDPAHLELKRYYSICQDTALGGPGFQERGGELKREEKTRNSLSPTIAPKLSLEVRKLSNGRLSTSLKLGPLQPRGVPLREKKATQMVAIVLGAFIVCWLPFFLTHVLNTHCQTCHVSPELYSATTWLGYVNSALNPVIYTTFNIEFRKAFLKILSC

SEQ ID NO: 1238 - protein, 358 aa, homo sapiens
MPSVSPAGPSAGAVPNATAVTTVRTNASGLEVPLFHLFARLDEELHGTFPGLWLALMAVHGAIFLAGLVLNGLALYVFCCRTRAKTPSVIYTINLVVTDLLVGLSLPTRFAVYYGARGCLRCAFPHVLGYFLNMHCSILFLTCICVDRYLAIVRPEGSRRCRQPACARAVCAFVWLAAGAVTLSVLGVTGSRPCCRVFALTVLEFLLPLLVISVFTGRIMCALSRPGLLHQGRQRRVRAMQLLLTVLIIFLVCFTPFHARQVAVALWPDMPHHTSLVVYHVAVTLSSLNSCMDPIVYCFVTSGFQATVRGLFGQHGEREPSSGDVVSMHRSSKGSGRHHILSAGPHALTQALANGPEA

SEQ ID NO: 1239 - protein, 385 aa, homo sapiens
MWGRLLLWPLVLGFSLSGGTQTPSVYDESGSTGGGDDSTPSILPAPRGYPGQVCANDSDTLELPDSSRALLLGWVPTRLVPALYGLVLVVGLPANGLALWVLATQAPRLPSTMLLMNLAAADLLLALALPPRIAYHLRGQRWPFGEAACRLATAALYGHMYGSVLLLAAVSLDRYLALVHPLRARALRGRRLALGLCMAAWLMAAALALPLTLQRQTFRLARSDRVLCHDALPLDAQASHWQPAFTCLALLGCFLPLLAMLLCYGATLHTLAASGRRYGHALRLTAVVLASAVAFFVPSNLLLLLHYSDPSPSAWGNLYGAYVPSLALSTLNSCVDPFIYYYVSAEFRDKVRAGLFQRSPGDTVASKASAEGGSRGMGTHSSLLQ

SEQ ID NO: 1240 - protein, 433 aa, homo sapiens
MCFSPILEINMQSESNITVRDDIDDINTNMYQPLSYPLSFQVSLTGFLMLEIVLGLGSNLTVLVLYCMKSNLINSVSNIITMNLHVLDVIICVGCIPLTIVILLLSLESNTALICCFHEACVSFASVSTAINVFAITLDRYDISVKPANRILTMGRAVMLMISIWIFSFFSFLIPFIEVNFFSLQSGNTWENKTLLCVSTNEYYTELGMYYHLLVQIPIFFFTVVVMLITYTKILQALNIRIGTRFSTGQKKKARKKKTISLTTQHEATDMSQSSGGRNVVFGVRTSVSVIIALRRAVKRHRERRERQKRVFRMSLLIISTFLLCWTPISVLNTTILCLGPSDLLVKLRLCFLVMAYGTTIFHPLLYAFTRQKFQKVLKSKMKKRVVSIVEADPLPNNAVIHNSWIDPKRNKKITFEDSEIREKCLVPQVVTD

SEQ ID NO: 1241 - protein, 1215 aa, homo sapiens
MGAMAYPLLLCLLLAQLGLGAVGASRDPQGRPDSPRERTPKGKPHAQQPGRASASDSSAPWSRSTDGTILAQKLAEEVPMDVASYLYTGDSHQLKRANCSGRYELAGLPGKWPALASAHPSLHRALDTLTHATNFLNVMLQSNKSREQNLQDDLDWYQALVWSLLEGEPSISRAAITFSTDSLSAPAPQVFLQATREESRILLQDLSSSAPHLANATLETEWFHGLRRKWRPHLHRRGPNQGPRGLGHSWRRKDGLGGDKSHFKWSPPYLECENGSYKPGWLVTLSSAIYGLQPNLVPEFRGVMKVDINLQKVDIDQCSSDGWFSGTHKCHLNNSECMPIKGLGFVLGAYECICKAGFYHPGVLPVNNFRRRGPDQHISGSTKDVSEEAYVCLPCREGCPFCADDSPCFVQEDKYLRLAIISFQALCMLLDFVSMLVVYHFRKAKSIRASGLILLETILFGSLLLYFPVVILYFEPSTFRCILLRWARLLGFATVYGTVTLKLHRVLKVFLSRTAQRIPYMTGGRVMRMLAVILLVVFWFLIGWTSSVCQNLEKQISLIGQGKTSDHLIFNMCLIDRWDYMTAVAEFLFLLWGVYLCYAVRTVPSAFHEPRYMAVAVHNELIISAIFHTIRFVLASRLQSDWMLMLYFAHTHLTVTVTIGLLLIPKFSHSSNNPRDDIATEAYEDELDMGRSGSYLNSSINSAWSEHSLDPEDIRDELKKLYAQLEIYKRKKMITNNPHLQKKRCSKKGLGRSIMRRITEIPETVSRQCSKEDKEGADHGTAKGTALIRKNPPESSGNTGKSKEETLKNRVFSLKKSHSTYDHVRDQTEESSSLPTESQEEETTENSTLESLSGKKLTQKLKEDSEAESTESVPLVCKSASAHNLSSEKKTGHPRTSMLQKSLSVIASAKEKTLGLAGKTQTAGVEERTKSQKPLPKDKETNRNHSNSDNTETKDPAPQNSNPAEEPRKPQKSGIMKQQRVNPTTANSDLNPGTTQMKDNFDIGEVCPWEVYDLTPGPVPSESKVQKHVSIVASEMEKNPTFSLKEKSHHKPKAAEVCQQSNQKRIDKAEVCLWESQGQSILEDEKLLISKTPVLPERAKEENGGQPRAANVCAGQSEELPPKAVASKTENENLNQIGHQEKKTSSSEENVRGSYNSSNNFQQPLTSRAEVCPWEFETPAQPNAGRSVALPASSALSANKIAGPRKEEIWDSFKV

SEQ ID NO: 1242 - protein, 335 aa, homo sapiens
MQPSPPPTELVPSERAVVLLSCALSALGSGLLVATHALWPDLRSRARRLLLFLSLADLLSAASYFYGVLQNFAGPSWDCVLQGALSTFANTSSFFWTVAIALYLYLSIVRAARGPRTDRLLWAFHVVSWGVPLVITVAAVALKKIGYDASDVSVGWCWIDLEAKDHVLWMLLTGKLWEMLAYVLLPLLYLLVRKHINRAHTALSEYRPILSQEHRLLRHSSMADKKLVLIPLIFIGLRVWSTVRFVLTLCGSPAVQTPVLVVLHGIGNTFQGGANCIMFVLCTRAVRTRLFSLCCCCCSSQPPTKSPAGTPKAPAPSKPGESQESQGTPGELPST

SEQ ID NO: 1243 - protein, 340 aa, homo sapiens
MNPFHASCWNTSAELLNKSWNKEFAYQTASVVDTVILPSMIGIICSTGLVGNILIVFTIIRSRKKTVPDIYICNLAVADLVHIVGMPFLIHQWARGGEWVFGGPLCTIITSLDTCNQFACSAIMTVMSVDRYFALVQPFRLTRWRTRYKTIRINLGLWAASFILALPVWVYSKVIKFKDGVESCAFDLTSPDDVLWYTLYLTITTFFFPLPLILVCYILILCYTWEMYQQNKDARCCNPSVPKQRVMKLTKMVLVLVVVFILSAAPYHVIQLVNLQMEQPTLAFYVGYYLSICLSYASSSINPFLYILLSGNFQKRLPQIQRRATEKEINNMGNTLKSHF

SEQ ID NO: 1244 - protein, 2367 aa, homo sapiens
MGTRGAVMPPPMWGLLGCCFVCAWALGGPRPIRSLPPLSSQVKPGSVPMQVPLEGAEAALAYLYSGDAQQLSQVNCSERYEARGAGAMPGLPPSLQGAAGTLAQAANFLNMLLQANDIRESSVEEDVEWYQALVRSVAEGDPRVYRALLTFNPPPGASHLQLALQATRTGEETILQDLSGNWVQEENPPGDLDTPALKKRVLTNDLGSLGSPKWPQADGYVGDTQQVRLSPPFLECQEGRLRPGWLITLSATFYGLKPDLSPEVRGQVQMDVDLQSVDINQCASGPGWYSNTHLCDLNSTQCVPLESQGFVLGRYLCRCRPGFYGASPSGGLEESDFQTTGQFGFPEGRSGRLLQCLPCPEGCTSCMDATPCLVEEAAVLRAAVLACQACCMLAIFLSMLVSYRCRRNKRIWASGVVLLETVLFGFLLLYFPVFILYFKPSVFRCIALRWVRLLGFAIVYGTIILKLYRVLQLFLSRTAQRSALLSSGRLLRRLGLLLLPVLGFLAVWTVGALERGIQHAPLVIRGHTPSGRHFYLCHHDRWDYIMVVAELLLLCWGSFLCYATRAVLSAFHEPRYMGIALHNELLLSAAFHTARFVLVPSLHPDWTLLLFFFHTHSTVTTTLALIFIPKFWKLGAPPREEMVDEVCEDELDLQHSGSYLGSSIASAWSEHSLDPGDIRDELKKLYAQLEVHKTKEMAANNPHLPKKRGSSCQGLGRSFMRYLAEFPEALARQHSRDSGSPGHGSLPGSSRRRLLSSSLQEPEGTPALHKSRSTYDQRREQDPPLLDSLLRRKLAKKASRTESRESVEGPPALGFRSASAHNLTVGERLPRARPASLQKSLSVASSREKALLMASQAYLEETYRQAKEREERKKAKAAMASLVRRPSARRLERPRGAPLSAPPSPAKSSSVDSSHTSGRLHEEARRRLPHPPIRHQVSTPILALSGGLGEPRMLSPTSTLAPALLPALAPTPAPALAPVPVSPQSPNLLTYICPWENAELPAKQENVPQEGPSGPERGHHSPAPARARLWRALSVAVEKSRAGENEMDAEDAHHQREANDVDEDRPKIFPKSHSLKAPVQQGSMRSLGLAIKALTRSRSTYREKESVEESPEGQNSGTAGESMGAPSRSPRLGRPKAVSKQAALIPSDDKESLQNQQNAHTSRMLQVCQREGSREQEDRGRRMTQGLGERKAERAGKTGLAMLRQVSRDKNIKQSKETPVGWQELPKAGLQSLGSADHRVAEVCPWEVTESETRQPDSGNKAEICPWETSEGAPESRALRQDPGDSQKKRGEARGKSEPIDVVPMMRKKPERLVREQEAVCPWESADRGGLSPGSAPQDPGRIRDKSEAGDSVEARKVEKPGWEAAGPEAHTPDITKAEPCPWEASEGGEDGKPAQEAVKDLPQEKQKTRKATFWKEQKPGGDLESLCPWESTDFRGPSAVSIQAPGSSECSGSLGSGIAEVCLWEAGDAPAIQKAEICPWELDDNVMGQEMLSLGTGRESLQEKEKASRKGSFGEMGEQTVKAVQKLSQQQESVCPRESTVPGHSSPCLDNSSSKAGSQFLCNGGSRATQVCPQEDLRPEAQEATPAKTEICPWEVNERTREEWTSAQVPRGGESQKDKEKMPGKSEIEDVTAWEKPEGQIQKQEAVGPWESVDPGSFSPQPRPQDTERPQTLLQMSGSVGSKAADICPLDVEENLTAGKAEICPWEVGAGAGEERALGAEAIRKSPNDTGKVSADLGPRERAVTAPEKPQKPTPEWEVACPWGSVGPGACSQHPGTLDADGPKAGFQELDHMGCRPGEVCPWEAQEAATSEKAKICPWEVSEGTTGKGLDQKAGSESAEQREKALEKGRLTSLGEDVSKGMAKLCQQQETICIWENKDLRESPAQAPKISDLPSSMSSEVAEGHSLEATEKGDLRQDPKTGSFPEHITQEKAPAADTEEFTTEDGEKTSHELQSVCPWETTAPADSVSHLDRQRPDQPKASSQRLVSTGGRAADVCPWDVPDAGVYKSDSSAKAETCPWEVTERIPVKGVSRQDGKGDSQEEKGRAPEKSEPKGVPVQKKPEMADFRQQEAVCPWESQDGKGLSPQPAPDASDRSRGSSEAAGSVETRVAEVCLWEVVEAPSAKKAEICPWEAGGGAAEEGEQERESQGQGEMFLQKAGPGGTEEHFSKAAAKPREQEAVCPGEGTGSGGLLPQSGALDPELKVSPKEAGSMGSRMAELCQWEITDPEGNKIKGTMADICPGEETGVPSEESGLLALTATRREFFPTAPEKPLCLLVHGPLDHFFPESKIPCPKVSRPASTFTLEGVRELQGPSGLEPRTSLAPEPSLQEAESQSSSLTEDSGQVAFEAQYEEFTPPTVYPWDWE

SEQ ID NO: 1245 - protein, 699 aa, homo sapiens
MKQRFSALQLLKLLLLLQPPLPRALREALCPEPCNCVPDGALRCPGPTAGLTRLSLAYLPVKVIPSQAFRGLNEVIKIEISQIDSLERIEANAFDNLLNLSEILIQNTKNLRYIEPGAFINLPRLKYLSICNTGIRKFPDVTKVFSSESNFILEICDNLHITTIPGNAFQGMNNESVTLKLYGNGFEEVQSHAFNGTTLTSLELKENVHLEKMHNGAFRGATGPKTLDISSTKLQALPSYGLESIQRLIATSSYSLKKLPSRETFVNLLEATLTYPSHCCAFRNLPTKEQNFSHSISENFSKQCESTVRKVNNKTLYSSMLAESELSGWDYEYGFCLPKTPRCAPEPDAFNPCEDIMGYDFLRVLIWLINILAIMGNMTVLFVLLTSRYKLTVPRFLMCNLSFADFCMGLYLLLIASVDSQTKGQYYNHAIDWQTGSGCSTAGFFTVFASELSVYTLTVITLERWHTITYAIHLDQKLRLRHAILIMLGGWLFSSLIAMLPLVGVSNYMKVSICFPMDVETTLSQVYILTILILNVVAFFIICACYIKIYFAVRNPELMATNKDTKIAKKMAILIFTDFTCMAPISFFAISAAFKVPLITVTNSKVLLVLFYPINSCANPFLYAIFTKTFQRDFFLLLSKFGCCKRRAELYRRKDFSAYTSNCKNGFTGSNKPSQSTLKLSTLHCQGTALLDKTRYTEC

SEQ ID NO: 1246 - protein, 877 aa, homo sapiens
MARPRRAREPLLVALLPLAWLAQAGLARAAGSVRLAGGLTLGGLFPVHARGAAGRACGQLKKEQGVHRLEAMLYALDRVNADPELLPGVRLGARLLDTCSRDTYALEQALSFVQALIRGRGDGDEVGVRCPGGVPPLRPAPPERVVAVVGASASSVSIMVANVLRLFAIPQISYASTAPELSDSTRYDFFSRVVPPDSYQAQAMVDIVRALGWNYVSTLASEGNYGESGVEAFVQISREAGGVCIAQSIKIPREPKPGEFSKVIRRLMETPNARGIIIFANEDDIRRVLEAARQANLTGHFLWVGSDSWGAKTSPILSLEDVAVGAITILPKRASIDGFDQYFMTRSLENNRRNIWFAEFWEENFNCKLTSSGTQSDDSTRKCTGEERIGRDSTYEQEGKVQFVIDAVYAIAHALHSMHQALCPGHTGLCPAMEPTDGRMLLQYIRAVRFNGSAGTPVMFNENGDAPGRYDIFQYQATNGSASSGGYQAVGQWAETLRLDVEALQWSGDPHEVPSSLCSLPCGPGERKKMVKGVPCCWHCEACDGYRFQVDEFTCEACPGDMRPTPNHTGCRPTPVVRLSWSSPWAAPPLLLAVLGIVATTTVVATFVRYNNTPIVRASGRELSYVLLTGIFLIYAITFLMVAEPGAAVCAARRLFLGLGTTLSYSALLTKTNRIYRIFEQGKRSVTPPPFISPTSQLVITFSLTSLQVVGMIAWLGARPPHSVIDYEEQRTVDPEQARGVLKCDMSDLSLIGCLGYSLLLMVTCTVYAIKARGVPETFNEAKPIGFTMYTTCIIWLAFVPIFFGTAQSAEKIYIQTTTLTVSLSLSASVSLGMLYVPKTYVILFHPEQNVQKRKRSLKATSTVAAPPKGEDAEAHK

SEQ ID NO: 1247 - protein, 418 aa, homo sapiens
MRLNSSAPGTPGTPAADPFQRAQAGLEEALLAPGFGNASGNASERVLAAPSSELDVNTDIYSKVLVTAVYLALFVVGTVGNTVTAFTLARKKSLQSLQSTVHYHLGSLALSDLLTLLLAMPVELYNFIWVHHPWAFGDAGCRGYYFLRDACTYATALNVASLSVERYLAICHPFKAKTLMSRSRTKKFISAIWLASALLAVPMLFTMGEQNRSADGQHAGGLVCTPTIHTATVKVVIQVNTFMSFIFPMVVISVLNTIIANKLTVMVRQAAEQGQVCTVGGEHSTFSMAIEPGRVQALRHGVRVLRAVVIAFVVCWLPYHVRRLMFCYISDEQWTPFLYDFYHYFYMVTNALFYVSSTINPILYNLVSANFRHIFLATLACLCPVWRRRRKRPAFSRKADSVSSNHTLSSNATRETLY

SEQ ID NO: 1248 - protein, 348 aa, homo sapiens
MVNNFSQAEAVELCYKNVNESCIKTPYSPGPRSILYAVLGFGAVLAAFGNLLVMIAILHFKQLHTPTNFLIASLACADFLVGVTVMPFSTVRSVESCWYFGDSYCKFHTCFDTSFCFASLFHLCCISVDRYIAVTDPLTYPTKFTVSVSGICIVLSWFFSVTYSFSIFYTGANEEGIEELVVALTCVGGCQAPLNQNWVLLCFLLFFIPNVAMVFIYSKIFLVAKHQARKIESTASQAQSSSESYKERVAKRERKAAKTLGIAMAAFLVSWLPYLVDAVIDAYMNFITPPYVYEILVWCVYYNSAMNPLIYAFFYQWFGKAIKLIVSGKVLRTDSSTTNLFSEEVETD

SEQ ID NO: 1249 - protein, 466 aa, homo sapiens
MVFLSGNASDSSNCTQPPAPVNISKAILLGVILGGLILFGVLGNILVILSVACHRHLHSVTHYYIVNLAVADLLLTSTVLPFSAIFEVLGYWAFGRVFCNIWAAVDVLCCTASIMGLCIISIDRYIGVSYPLRYPTIVTQRRGLMALLCVWALSLVISIGPLFGWRQPAPEDETICQINEEPGYVLFSALGSFYLPLAIILVMYCRVYVVAKRESRGLKSGLKTDKSDSEQVTLRIHRKNAPAGGSGMASAKTKTHFSVRLLKFSREKKAAKTLGIVVGCFVLCWLPFFLVMPIGSFFPDFKPSETVFKIVFWLGYLNSCINPIIYPCSSQEFKKAFQNVLRIQCLCRKQSSKHALGYTLHPPSQAVEGQHKDMVRIPVGSRETFYRISKTDGVCEWKFFSSMPRGSARITVSKDQSSCTTARVRSKSFLQVCCCVGPSTPSLDKNHQVPTIKVHTISLSENGEEV

SEQ ID NO: 1250 - protein, 1584 aa, homo sapiens
MRGQAAAPGPVWILAPLLLLLLLLGRRARAAAGADAGPGPEPCATLVQGKFFGYFSAAAVFPANASRCSWTLRNPDPRRYTLYMKVAKAPVPCSGPGRVRTYQFDSFLESTRTYLGVESFDEVLRLCDPSAPLAFLQASKQFLQMRRQQPPQHDGLRPRAGPPGPTDDFSVEYLVVGNRNPSRAACQMLCRWLDACLAGSRSSHPCGIMQTPCACLGGEAGGPAAGPLAPRGDVCLRDAVAGGPENCLTSLTQDRGGHGATGGWKLWSLWGECTRDCGGGLQTRTRTCLPAPGVEGGGCEGVLEEGRQCNREACGPAGRTSSRSQSLRSTDARRREELGDELQQFGFPAPQTGDPAAEEWSPWSVCSSTCGEGWQTRTRFCVSSSYSTQCSGPLREQRLCNNSAVCPVHGAWDEWSPWSLCSSTCGRGFRDRTRTCRPPQFGGNPCEGPEKQTKFCNIALCPGRAVDGNWNEWSSWSACSASCSQGRQQRTRECNGPSYGGAECQGHWVETRDCFLQQCPVDGKWQAWASWGSCSVTCGAGSQRRERVCSGPFFGGAACQGPQDEYRQCGTQRCPEPHEICDEDNFGAVIWKETPAGEVAAVRCPRNATGLILRRCELDEEGIAYWEPPTYIRCVSIDYRNIQMMTREHLAKAQRGLPGEGVSEVIQTLVEISQDGTSYSGDLLSTIDVLRNMTEIFRRAYYSPTPGDVQNFVQILSNLLAEENRDKWEEAQLAGPNAKELFRLVEDFVDVIGFRMKDLRDAYQVTDNLVLSIHKLPASGATDISFPMKGWRATGDWAKVPEDRVTVSKSVFSTGLTEADEASVFVVGTVLYRNLGSFLALQRNTTVLNSKVISVTVKPPPRSLRTPLEIEFAHMYNGTTNQTCILWDETDVPSSSAPPQLGPWSWRGCRTVPLDALRTRCLCDRLSTFAILAQLSADANMEKATLPSVTLIVGCGVSSLTLLMLVIIYVSVWRYIRSERSVILINFCLSIISSNALILIGQTQTRNKVVCTLVAAFLHFFFLSSFCWVLTEAWQSYMAVTGHLRNRLIRKRFLCLGWGLPALVVAISVGFTKAKGYSTMNYCWLSLEGGLLYAFVGPAAAVVLVNMVIGILVFNKLVSKDGITDKKLKERAGASLWSSCVVLPLLALTWMSAVLAVTDRRSALFQILFAVFDSLEGFVIVMVHCILRREVQDAVKCRVVDRQEEGNGDSGGSFQNGHAQLMTDFEKDVDLACRSVLNKDIAACRTATITGTLKRPSLPEEEKLKLAHAKGPPTNFNSLPANVSKLHLHGSPRYPGGPLPDFPNHSLTLKRDKAPKSSFVGDGDIFKKLDSELSRAQEKALDTSYVILPTATATLRPKPKEEPKYSIHIDQMPQTRLIHLSTAPEASLPARSPPSRQPPSGGPPEAPPAQPPPPPPPPPPPPQQPLPPPPNLEPAPPSLGDPGEPAAHPGPSTGPSTKNENVATLSVSSLERRKSRYAELDFEKIMHTRKRHQDMFQDLNRKLQHAAEKDKEVLGPDSKPEKQQTPNKRPWESLRKAHGTPTWVKKELEPLQPSPLELRSVEWERSGATIPLVGQDIIDLQTEV

SEQ ID NO: 1251 - protein, 926 aa, homo sapiens
MAFLIILITCFVIILATSQPCQTPDDFVAATSPGHIIIGGLFAIHEKMLSSEDSPRRPQIQECVGFEISVFLQTLAMIHSIEMINNSTLLPGVKLGYEIYDTCTEVTVAMAATLRFLSKFNCSRETVEFKCDYSSYMPRVKAVIGSGYSEITMAVSRMLNLQLMPQVGYESTAEILSDKIRFPSFLRTVPSDFHQIKAMAHLIQKSGWNWIGIITTDDDYGRLALNTFIIQAEANNVCIAFKEVLPAFLSDNTIEVRINRTLKKIILEAQVNVIVVFLRQFHVFDLFNKAIEMNINKMWIASDNWSTATKITTIPNVKKIGKVVGFAFRRGNISSFHSFLQNLHLLPSDSHKLLHEYAMHLSACAYVKDTDLSQCIFNHSQRTLAYKANKAIERNFVMRNDFLWDYAEPGLIHSIQLAVFALGYAIRDLCQARDCQNPNAFQPWELLGVLKNVTFTDGWNSFHFDAHGDLNTGYDVVLWKEINGHMTVTKMAEYDLQNDVFIIPDQETKNEFRNLKQIQSKCSKECSPGQMKKTTRSQHICCYECQNCPENHYTNQTDMPHCLLCNNKTHWAPVRSTMCFEKEVEYLNWNDSLAILLLILSLLGIIFVLVVGIIFTRNLNTPVVKSSGGLRVCYVILLCHFLNFASTSFFIGEPQDFTCKTRQTMFGVSFTLCISCILTKSLKILLAFSFDPKLQKFLKCLYRPILIIFTCTGIQVVICTLWLIFAAPTVEVNVSLPRVIILECEEGSILAFGTMLGYIAILAFICFIFAFKGKYENYNEAKFITFGMLIYFIAWITFIPIYATTFGKYVPAVEIIVILISNYGILYCTFIPKCYVIICKQEINTKSAFLKMIYSYSSHSVSSIALSPASLDSMSGNVTMTNPSSSGKSATWQKSKDLQAQAFAHICRENATSVSKTLPRKRMSSI

SEQ ID NO: 1252 - protein, 6306 aa, homo sapiens
MSVFLGPGMPSASLLVNLLSALLILFVFGETEIRFTGQTEFVVNETSTTVIRLIIERIGEPANVTAIVSLYGEDAGDFFDTYAAAFIPAGETNRTVYIAVCDDDLPEPDETFIFHLTLQKPSANVKLGWPRTVTVTILSNDNAFGIISFNMLPSIAVSEPKGRNESMPLTLIREKGTYGMVMVTFEVEGGPNPPDEDLSPVKGNITFPPGRATVIYNLTVLDDEVPENDEIFLIQLKSVEGGAEINTSRNSIEIIIKKNDSPVRFLQSIYLVPEEDHILIIPVVRGKDNNGNLIGSDEYEVSISYAVTTGNSTAHAQQNLDFIDLQPNTTVVFPPFIHESHLKFQIVDDTIPEIAESFHIMLLKDTLQGDAVLISPSVVQVTIKPNDKPYGVLSFNSVLFERTVIIDEDRISRYEEITVVRNGGTHGNVSANWVLTRNSTDPSPVTADIRPSSGVLHFAQGQMLATIPLTVVDDDLPEEAEAYLLQILPHTIRGGAEVSEPAELLFYIQDSDDVYGLITFFPMENQKIESSPGERYLSLSFTRLGGTKGDVRLLYSVLYIPAGAVDPLQAKEGILNISRRNDLIFPEQKTQVTTKLPIRNDAFLQNGAHFLVQLETVELLNIIPLIPPISPRFGEICNISLLVTPAIANGEIGFLSNLPIILHEPEDFAAEVVYIPLHRDGTDGQATVYWSLKPSGFNSKAVTPDDIGPFNGSVLFLSGQSDTTINITIKGDDIPEMNETVTLSLDRVNVENQVLKSGYTSRDLIILENDDPGGVFEFSPASRGPYVIKEGESVELHIIRSRGSLVKQFLHYRVEPRDSNEFYGNTGVLEFKPGEREIVITLLARLDGIPELDEHYWVVLSSHGERESKLGSATIVNITILKNDDPHGIIEFVSDGLIVMINESKGDAIYSAVYDVVRNRGNFGDVSVSWVVSPDFTQDVFPVQGTVVFGDQEFSKNITIYSLPDEIPEEMEEFTVILLNGTGGAKVGNRTTATLRIRRNDDPIYFAEPRVVRVQEGETANFTVLRNGSVDVTCMVQYATKDGKATARERDFIPVEKGETLIFEVGSRQQSISIFVNEDGIPETDEPFYIILLNSTGDTVVYQYGVATVIIEANDDPNGIFSLEPIDKAVEEGKTNAFWILRHRGYFGSVSVSWQLFQNDSALQPGQEFYETSGTVNFMDGEEAKPIILHAFPDKIPEFNEFYFLKLVNISGGSPGPGGQLAETNLQVTVMVPFNDDPFGVFILDPECLEREVAEDVLSEDDMSYITNFTILRQQGVFGDVQLGWEILSSEFPAGLPPMIDFLLVGIFPTTVHLQQHMRRHHSGTDALYFTGLEGAFGTVNPKYHPSRNNTIANFTFSAWVMPNANTNGFIIAKDDGNGSIYYGVKIQTNESHVTLSLHYKTLGSNATYIAKTTVMKYLEESVWLHLLIILEDGIIEFYLDGNAMPRGIKSLKGEAITDGPGILRIGAGINGNDRFTGLMQDVRSYERKLTLEEIYELHAMPAKSDLHPISGYLEFRQGETNKSFIISARDDNDEEGEELFILKLVSVYGGARISEENTTARLTIQKSDNANGLFGFTGACIPEIAEEGSTISCVVERTRGALDYVHVFYTISQIETDGINYLVDDFANASGTITFLPWQRSEVLNIYVLDDDIPELNEYFRVTLVSAIPGDGKLGSTPTSGASIDPEKETTDITIKASDHPYGLLQFSTGLPPQPKDAMTLPASSVPHITVEEEDGEIRLLVIRAQGLLGRVTAEFRTVSLTAFSPEDYQNVAGTLEFQPGERYKYIFINITDNSIPELEKSFKVELLNLEGGVAELFRVDGSGSGDGDMEFFLPTIHKRASLGVASQILVTIAASDHAHGVFEFSPESLFVSGTEPEDGYSTVTLNVIRHHGTLSPVTLHWNIDSDPDGDLAFTSGNITFEIGQTSANITVEILPDEDPELDKAFSVSVLSVSSGSLGAHINATLTVLASDDPYGIFIFSEKNRPVKVEEATQNITLSIIRLKGLMGKVLVSYATLDDMEKPPYFPPNLARATQGRDYIPASGFALFGANQSEATIAISILDDDEPERSESVFIELLNSTLVAKVQSRSIPNSPRLGPKVETIAQLIIIANDDAFGTLQLSAPIVRVAENHVGPIINVTRTGGAFADVSVKFKAVPITAIAGEDYSIASSDVVLLEGETSKAVPIYVINDIYPELEESFLVQLMNETTGGARLGALTEAVIIIEASDDPYGLFGFQITKLIVEEPEFNSVKVNLPIIRNSGTLGNVTVQWVATINGQLATGDLRVVSGNVTFAPGETIQTLLLEVLADDVPEIEEVIQVQLTDASGGGTIGLDRIANIIIPANDDPYGTVAFAQMVYRVQEPLERSSCANITVRRSGGHFGRLLLFYSTSDIDVVALAMEEGQDLLSYYESPIQGVPDPLWRTWMNVSAVGEPLYTCATLCLKEQACSAFSFFSASEGPQCFWMTSWISPAVNNSDFWTYRKNMTRVASLFSGQAVAGSDYEPVTRQWAIMQEGDEFANLTVSILPDDFPEMDESFLISLLEVHLMNISASLKNQPTIGQPNISTVVIALNGDAFGVFVIYNISPNTSEDGLFVEVQEQPQTLVELMIHRTGGSLGQVAVEWRVVGGTATEGLDFIGAGEILTFAEGETKKTVILTILDDSEPEDDESIIVSLVYTEGGSRILPSSDTVRVNILANDNVAGIVSFQTASRSVIGHEGEILQFHVIRTFPGRGNVTVNWKIIGQNLELNFANFSGQLFFPEGSLNTTLFVHLLDDNIPEEKEVYQVILYDVRTQGVPPAGIALLDAQGYAAVLTVEASDEPHGVLNFALSSRFVLLQEANITIQLFINREFGSLGAINVTYTTVPGMLSLKNQTVGNLAEPEVDFVPIIGFLILEEGETAAAINITILEDDVPELEEYFLVNLTYVGLTMAASTSFPPRLDSEGLTAQVIIDANDGARGVIEWQQSRFEVNETHGSLTLVAQRSREPLGHVSLFVYAQNLEAQVGLDYIFTPMILHFADGERYKNVNIMILDDDIPEGDEKFQLILTNPSPGLELGKNTIALIIVLANDDGPGVLSFNNSEHFFLREPTALYVQESVAVLYIVREPAQGLFGTVTVQFIVTEVNSSNESKDLTPSKGYIVLEEGVRFKALQISAILDTEPEMDEYFVCTLFNPTGGARLGVHVQTLITVLQNQAPLGLFSISAVENRATSIDIEEANRTVYLNVSRTNGIDLAVSVQWETVSETAFGMRGMDVVFSVFQSFLDESASGWCFFTLENLIYGIMLRKSSVTVYRWQGIFIPVEDLNIENPKTCEAFNIGFSPYFVITHEERNEEKPSLNSVFTFTSGFKLFLVQTIIILESSQVRYFTSDSQDYLIIASQRDDSELTQVFRWNGGSFVLHQKLPVRGVLTVALFNKGGSVFLAISQANARLNSLLFRWSGSGFINFQEVPVSGTTEVEALSSANDIYLIFAENVFLGDQNSIDIFIWEMGQSSFRYFQSVDFAAVNRIHSFTPASGIAHILLIGQDMSALYCWNSERNQFSFVLEVPSAYDVASVTVKSLNSSKNLIALVGAHSHIYELAYISSHSDFIPSSGELIFEPGEREATIAVNILDDTVPEKEESFKVQLKNPKGGAEIGINDSVTITILSNDDAYGIVAFAQNSLYKQVEEMEQDSLVTLNVERLKGTYGRITIAWEADGSISDIFPTSGVILFTEGQVLSTITLTILADNIPELSEVVIVTLTRITTEGVEDSYKGATIDQDRSKSVITTLPNDSPFGLVGWRAASVFIRVAEPKENTTTLQLQIARDKGLLGDIAIHLRAQPNFLLHVDNQATENEDYVLQETIIIMKENIKEAHAEVSILPDDLPELEEGFIVTITEVNLVNSDFSTGQPSVRRPGMEIAEIMIEENDDPRGIFMFHVTRGAGEVITAYEVPPPLNVLQVPVVRLAGSFGAVNVYWKASPDSAGLEDFKPSHGILEFADKQVTAMIEITIIDDAEFELTETFNISLISVAGGGRLGDDVVVTVVIPQNDSPFGVFGFEEKTVMIDESLSSDDPDSYVTLTVVRSPGGKGTVRLEWTIDEKAKHNLSPLNGTLHFDETESQKTIVLHTLQDTVLEEDRRFTIQLISIDEVEISPVKGSASIIIRGDKRASGEVGIAPSSRHILIGEPSAKYNGTAIISLVRGPGILGEVTVFWRIFPPSVGEFAETSGKLTMRDEQSAVIVVIQALNDDIPEEKSFYEFQLTAVSEGGVLSESSSTANITVVASDSPYGRFAFSHEQLRVSEAQRVNITIIRSSGDFGHVRLWYKTMSGTAEAGLDFVPAAGELLFEAGEMRKSLHVEILDDDYPEGPEEFSLTITKVELQGRGYDFTIQENGLQIDQPPEIGNISIVRIIIMKNDNAEGIIEFDPKYTAFEVEEDVGLIMIPVVRLHGTYGYVTADFISQSSSASPGGVDYILHGSTVTFQHGQNLSFINISIIDDNESEFEEPIEILLTGATGGAVLGRHLVSRIIIAKSDSPFGVIRFLNQSKISIANPNSTMILSLVLERTGGLLGEIQVNWETVGPNSQEALLPQNRDIADPVSGLFYFGEGEGGVRTIILTIYPHEEIEVEETFIIKLHLVKGEAKLDSRAKDVTLTIQEFGDPNGVVQFAPETLSKKTYSEPLALEGPLLITFFVRRVKGTFGEIMVYWELSSEFDITEDFLSTSGFFTIADGESEASFDVHLLPDEVPEIEEDYVIQLVSVEGGAELDLEKSITWFSVYANDDPHGVFALYSDRQSILIGQNLIRSIQINITRLAGTFGDVAVGLRISSDHKEQPIVTENAERQLVVKDGATYKVDVVPIKNQVFLSLGSNFTLQLVTVMLVGGRFYGMPTILQEAKSAVLPVSEKAANSQVGFESTAFQLMNITAGTSHVMISRRGTYGALSVAWTTGYAPGLEIPEFIVVGNMTPTLGSLSFSHGEQRKGVFLWTFPSPGWPEAFVLHLSGVQSSAPGGAQLRSGFIVAEIEPMGVFQFSTSSRNIIVSEDTQMIRLHVQRLFGFHSDLIKVSYQTTAGSAKPLEDFEPVQNGELFFQKFQTEVDFEITIINDQLSEIEEFFYINLTSVEIRGLQKFDVNWSPRLNLDFSVAVITILDNDDLAGMDISFPETTVAVAVDTTLIPVETESTTYLSTSKTTTILQPTNVVAIVTEATGVSAIPEKLVTLHGTPAVSEKPDVATVTANVSIHGTFSLGPSIVYIEEEMKNGTFNTAEVLIRRTGGFTGNVSITVKTFGERCAQMEPNALPFRGIYGISNLTWAVEEEDFEEQTLTLIFLDGERERKVSVQILDDDEPEGQEFFYVFLTNPQGGAQIVEEKDDTGFAAFAMVIITGSDLHNGIIGFSEESQSGLELREGAVMRRLHLIVTRQPNRAFEDVKVFWRVTLNKTVVVLQKDGVNLVEELQSVSGTTTCTMGQTKCFISIELKPEKVPQVEVYFFVELYEATAGAAINNSARFAQIKILESDESQSLVYFSVGSRLAVAHKKATLISLQVARDSGTGLMMSVNFSTQELRSAETIGRTIISPAISGKDFVITEGTLVFEPGQRSTVLDVILTPETGSLNSFPKRFQIVLFDPKGGARIDKVYGTANITLVSDADSQAIWGLADQLHQPVNDDILNRVLHTISMKVATENTDEQLSAMMHLIEKITTEGKIQAFSVASRTLFYEILCSLINPKRKDTRGFSHFAEVTENFAFSLLTNVTCGSPGEKSKTILDSCPYLSILALHWYPQQINGHKFEGKEGDYIRIPERLLDVQDAEIMAGKSTCKLVQFTEYSSQQWFISGNNLPTLKNKVLSLSVKGQSSQLLTNDNEVLYRIYAAEPRIIPQTSLCLLWNQAAASWLSDSQFCKVVEETADYVECACSHMSVYAVYARTDNLSSYNEAFFTSGFICISGLCLAVLSHIFCARYSMFAAKLLTHMMAASLGTQILFLASAYASPQLAEESCSAMAAVTHYLYLCQFSWMLIQSVNFWYVLVMNDEHTERRYLLFFLLSWGLPAFVVILLIVILKGIYHQSMSQIYGLIHGDLCFIPNVYAALFTAALVPLTCLVVVFVVFIHAYQVKPQWKAYDDVFRGRTNAAEIPLILYLFALISVTWLWGGLHMAYRHFWMLVLFVIFNSLQGLYVFMVYFILHNQMCCPMKASYTVEMNGHPGPSTAFFTPGSGMPPAGGEISKSTQNLIGAMEEVPPDWERASFQQGSQASPDLKPSPQNGATFPSSGGYGQGSLIADEESQEFDDLIFALKTGAGLSVSDNESGQGSQEGGTLTDSQIVELRRIPIADTHL

SEQ ID NO: 1253 - protein, 440 aa, homo sapiens
MRPHLSPPLQQLLLPVLLACAAHSTGALPRLCDVLQVLWEEQDQCLQELSREQTGDLGTEQPVPGCEGMWDNISCWPSSVPGRMVEVECPRFLRMLTSRNGSLFRNCTQDGWSETFPRPNLACGVNVNDSSNEKRHSYLLKLKVMYTVGYSSSLVMLLVALGILCAFRRLHCTRNYIHMHLFVSFILRALSNFIKDAVLFSSDDVTYCDAHRAGCKLVMVLFQYCIMANYSWLLVEGLYLHTLLAISFFSERKYLQGFVAFGWGSPAIFVALWAIARHFLEDVGCWDINANASIWWIIRGPVILSILINFILFINILRILMRKLRTQETRGNEVSHYKRLARSTLLLIPLFGIHYIVFAFSPEDAMEIQLFFELALGSFQGLVVAVLYCFLNGEVQLEVQKKWQQWHLREFPLHPVASFSNSTKASHLEQSQGTCRTSII

SEQ ID NO: 1254 - protein, 1585 aa, homo sapiens
MENTGWMGKGHRMTPACPLLLSVILSLRLATAFDPAPSACSALASGVLYGAFSLQDLFPTIASGCSWTLENPDPTKYSLYLRFNRQEQVCAHFAPRLLPLDHYLVNFTCLRPSPEEAVAQAESEVGRPEEEEAEAAAGLELCSGSGPFTFLHFDKNFVQLCLSAEPSEAPRLLAPAALAFRFVEVLLINNNNSSQFTCGVLCRWSEECGRAAGRACGFAQPGCSCPGEAGAGSTTTTSPGPPAAHTLSNALVPGGPAPPAEADLHSGSSNDLFTTEMRYGEEPEEEPKVKTQWPRSADEPGLYMAQTGDPAAEEWSPWSVCSLTCGQGLQVRTRSCVSSPYGTLCSGPLRETRPCNNSATCPVHGVWEEWGSWSLCSRSCGRGSRSRMRTCVPPQHGGKACEGPELQTKLCSMAACPVEGQWLEWGPWGPCSTSCANGTQQRSRKCSVAGPAWATCTGALTDTRECSNLECPATDSKWGPWNAWSLCSKTCDTGWQRRFRMCQATGTQGYPCEGTGEEVKPCSEKRCPAFHEMCRDEYVMLMTWKKAAAGEIIYNKCPPNASGSASRRCLLSAQGVAYWGLPSFARCISHEYRYLYLSLREHLAKGQRMLAGEGMSQVVRSLQELLARRTYYSGDLLFSVDILRNVTDTFKRATYVPSADDVQRFFQVVSFMVDAENKEKWDDAQQVSPGSVHLLRVVEDFIHLVGDALKAFQSSLIVTDNLVISIQREPVSAVSSDITFPMRGRRGMKDWVRHSEDRLFLPKEVLSLSSPGKPATSGAAGSPGRGRGPGTVPPGPGHSHQRLLPADPDESSYFVIGAVLYRTLGLILPPPRPPLAVTSRVMTVTVRPPTQPPAEPLITVELSYIINGTTDPHCASWDYSRADASSGDWDTENCQTLETQAAHTRCQCQHLSTFAVLAQPPKDLTLELAGSPSVPLVIGCAVSCMALLTLLAIYAAFWRFIKSERSIILLNFCLSILASNILILVGQSRVLSKGVCTMTAAFLHFFFLSSFCWVLTEAWQSYLAVIGRMRTRLVRKRFLCLGWGLPALVVAVSVGFTRTKGYGTSSYCWLSLEGGLLYAFVGPAAVIVLVNMLIGIIVFNKLMARDGISDKSKKQRAGSERCPWASLLLPCSACGAVPSPLLSSASARNAMASLWSSCVVLPLLALTWMSAVLAMTDRRSVLFQALFAVFNSAQGFVITAVHCFLRREVQDVVKCQMGVCRADESEDSPDSCKNGQLQILSDFEKDVDLACQTVLFKEVNTCNPSTITGTLSRLSLDEDEEPKSCLVGPEGSLSFSPLPGNILVPMAASPGLGEPPPPQEANPVYMCGEGGLRQLDLTWLRPTEPGSEGDYMVLPRRTLSLQPGGGGGGGEDAPRARPEGTPRRAAKTVAHTEGYPSFLSVDHSGLGLGPAYGSLQNPYGMTFQPPPPTPSARQVPEPGERSRTMPRTVPGSTMKMGSLERKKLRYSDLDFEKVMHTRKRHSELYHELNQKFHTFDRYRSQSTAKREKRWSVSSGGAAERSVCTDKPSPGERPSLSQHRRHQSWSTFKSMTLGSLPPKPRERLTLHRAAAWEPTEPPDGDFQTEV

SEQ ID NO: 1255 - protein, 384 aa, homo sapiens
MTNSSSTSTSSTTGGSLLLLCEEEESWAGRRIPVSLLYSGLAIGGTLANGMVIYLVSSFRKLQTTSNAFIVNGCAADLSVCALWMPQEAVLGLLPTGSAEPPADWDGAGGSYRLLRGGLLGLGLTVSLLSHCLVALNRYLLITRAPATYQALYQRRHTAGMLALSWALALGLVLLLPPWAPRPGAAPPRVHYPALLAAAALLAQTALLLHCYLGIVRRVRVSVKRVSVLNFHLLHQLPGCAAAAAAFPGAQHAPGPGGAAHPAQAQPLPPALHPRRAQRRLSGLSVLLLCCVFLLATQPLVWVSLASGFSLPVPWGVQAASWLLCCALSALNPLLYTWRNEEFRRSVRSVLPGVGDAAAAAVAATAVPAVSQAQLGTRAAGQHW

SEQ ID NO: 1256 - protein, 330 aa, homo sapiens
MTPNSTGEVPSPIPKGALGLSLALASLIITANLLLALGIAWDRRLRSPPAGCFFLSLLLAGLLTGLALPTLPGLWNQSRRGYWSCLLVYLAPNFSFLSLLANLLLVHGERYMAVLRPLQPPGSIRLALLLTWAGPLLFASLPALGWNHWTPGANCSSQAIFPAPYLYLEVYGLLLPAVGAAAFLSVRVLATAHRQLQDICRLERAVCRDEPSALARALTWRQARAQAGAMLLFGLCWGPYVATLLLSVLAYEQRPPLGPGTLLSLLSLGSASAAAVPVAMGLGDQRYTAPWRAAAQRCLQGLWGRASRDSPGPSIAYHPSSQSSVDLDLN

SEQ ID NO: 1257 - protein, 695 aa, homo sapiens
MKMKSQATMICCLVFFLSTECSHYRSKIHLKAGDKLQSPEGKPKTGRIQEKCEGPCISSSNCSQPCAKDFHGEIGFTCNQKKWQKSAETCTSLSVEKLFKDSTGASRLSVAAPSIPLHILDFRAPETIESVAQGIRKNCPFDYACITDMVKSSETTSGNIAFIVELLKNISTDLSDNVTREKMKSYSEVANHILDTAAISNWAFIPNKNASSDLLQSVNLFARQLHIHNNSENIVNELFIQTKGFHINHNTSEKSLNFSMSMNNTTEDILGMVQIPRQELRKLWPNASQAISIAFPTLGAILREAHLQNVSLPRQVNGLVLSVVLPERLQEIILTFEKINKTRNARAQCVGWHSKKRRWDEKACQMMLDIRNEVKCRCNYTSVVMSFSILMSSKSMTDKVLDYITCIGLSVSILSLVLCLIIEATVWSRVVVTEISYMRHVCIVNIAVSLLTANVWFIIGSHFNIKAQDYNMCVAVTFFSHFFYLSLFFWMLFKALLIIYGILVIFRRMMKSRMMVIGFAIGYGCPLIIAVTTVAITEPEKGYMRPEACWLNWDNTKALLAFAIPAFVIVAVNLIVVLVVAVNTQRPSIGSSKSQDVVIIMRISKNVAILTPLLGLTWGFGIATLIEGTSLTFHIIFALLNAFQGFFILLFGTIMDHKIRDALRMRMSSLKGKSRAAENASLGPTNGSKLMNRQG

SEQ ID NO: 1258 - protein, 400 aa, homo sapiens
MDSSAAPTNASNCTDALAYSSCSPAPSPGSWVNLSHLDGNLSDPCGPNRTDLGGRDSLCPPTGSPSMITAITIMALYSIVCVVGLFGNFLVMYVIVRYTKMKTATNIYIFNLALADALATSTLPFQSVNYLMGTWPFGTILCKIVISIDYYNMFTSIFTLCTMSVDRYIAVCHPVKALDFRTPRNAKIINVCNWILSSAIGLPVMFMATTKYRQGSIDCTLTFSHPTWYWENLLKICVFIFAFIMPVLIITVCYGLMILRLKSVRMLSGSKEKDRNLRRITRMVLVVVAVFIVCWTPIHIYVIIKALVTIPETTFQTVSWHFCIALGYTNSCLNPVLYAFLDENFKRCFREFCIPTSSNIEQQNSTRIRQNTRDHPSTANTVDRTNHQLENLEAETAPLP

SEQ ID NO: 1259 - protein, 332 aa, homo sapiens [sequence omitted]

SEQ ID NO: 1260 - protein, 1003 aa, homo sapiens
MVFSVRQCGHVGRTEEVLLTFKIFLVIICLHVVLVTSLEEDTDNSSLSPPPAKLSVVSFAPSSNGTPEVETTSLNDVTLSLLPSNETGVKPQRNICNLSSICNDSAFFRGEIMFQYDKESTVPQNQHITNGTLTGVLSLSELKRSELNKTLQTLSETYFIMCATAEAQSTLNCTFTIKLNNTMNACAVIAALERVKIRPMEHCCCSVRIPCPSSPEELEKLQCDLQDPIVCLADHPRGPPFSSSQSIPVVPRATVLSQVPKATSFAEPPDYSPVTHNVPSPIGEIQPLSPQPSAPIASSPAIDMPPQSETISSPMPQTHVSGTPPPVKASFSSPTVSAPANVNTTSAPPVQTDIVNTSSISDLENQVLQMEKALSLGSLEPNLAGEMINQVSRLLHSPPDMLAPLAQRLLKVVDDIGLQLNFSNTTISLTSPSLALAVIRVNASSFNTTTFVAQDPANLQVSLETQAPENSIGTITLPSSLMNNLPAHDMELASRVQFNFFETPALFQDPSLENLSLISYVISSSVANLTVRNLTRNVTVTLKHINPSQDELTVRCVFWDLGRNGGRGGWSDNGCSVKDRRLNETICTCSHLTSFGVLLDLSRTSVLPAQMMALTFITYIGCGLSSIFLSVTLVTYIAFEKIRRDYPSKILIQLCAALLLLNLVFLLDSWIALYKMQGLCISVAVFLHYFLLVSFTWMGLEAFHMYLALVKVFNTYIRKYILKFCIVGWGVPAVVVTIILTISPDNYGLGSYGKFPNGSPDDFCWINNNAVFYITVVGYFCVIFLLNVSMFIVVLVQLCRIKKKKQLGAQRKTSIQDLRSIAGLTFLLGITWGFAFFAWGPVNVTFMYLFAIFNTLQGFFIFIFYCVAKENVRKQWRRYLCCGKLRLAENSDWSKTATNGLKKQTVNQGVSSSSNSLQSSSNSTNSTTLLVNNDCSVHASGNGNASTERNGVSFSVQNGDVCLHDFTGKQHMFNEKEDSCNGKGRMALRRTSKRGSLHFIEQM

SEQ ID NO: 1261 - protein, 338 aa, homo sapiens
MINSTSTQPPDESCSQNLLITQQIIPVLYCMVFIAGILLNGVSGWIFFYVPSSKSFIIYLKNIVIADFVMSLTFPFKILGDSGLGPWQLNVFVCRVSAVLFYVNMYVSIVFFGLISFDRYYKIVKPLWTSFIQSVSYSKLLSVIVWMLMLLLAVPNIILTNQSVREVTQIKCIELKSELGRKWHKASNYIFVAIFWIVFLLLIVFYTAITKKIFKSHLKSSRNSTSVKKKSSRNIFSIVFVFFVCFVPYHIARIPYTKSQTEAHYSCQSKEILRYMKEFTLLLSAANVCLDPIIYFFLCQPFREILCKKLHIPLKAQNDLDISRIKRGNTTLESTDTL

SEQ ID NO: 1262 - protein, 322 aa, homo sapiens
MDPTISTLDTELTPINGTEETLCYKQTLSLTVLTCIVSLVGLTGNAVVLWLLGCRMRRNAFSIYILNLAAADFLFLSGRLIYSLLSFISIPHTISKILYPVMMFSYFAGLSFLSAVSTERCLSVLWPIWYRCHRPTHLSAVVCVLLWALSLLRSILEWMLCGFLFSGADSAWCQTSDFITVAWLIFLCVVLCGSSLVLLIRILCGSRKIPLTRLYVTILLTVLVFLLCGLPFGIQFFLFLWIHVDREVLFCHVHLVSIFLSALNSSANPIIYFFVGSFRQRQNRQNLKLVLQRALQDASEVDEGGGQLPEEILELSGSRLEQ

SEQ ID NO: 1263 - protein, 652 aa, homo sapiens
MQGPLLLPGLCFLLSLFGAVTQKTKTSCAKCPPNASCVNNTHCTCNHGYTSGSGQKLFTFPLETCNDINECTPPYSVYCGFNAVCYNVEGSFYCQCVPGYRLHSGNEQFSNSNENTCQDTTSSKTTEGRKELQKIVDKFESLLTNQTLWRTEGRQEISSTATTILRDVESKVLETALKDPEQKVLKIQNDSVAIETQAITDNCSEERKTFNLNVQMNSMDIRCSDIIQGDTQGPSAIAFISYSSLGNIINATFFEEMDKKDQVYLNSQVVSAAIGPKRNVSLSKSVTLTFQHVKMTPSTKKVFCVYWKSTGQGSQWSRDGCFLIHVNKSHTMCNCSHLSSFAVLMALTSQEEDPVLTVITYVGLSVSLLCLLLAALTFLLCKAIRNTSTSLHLQLSLCLFLAHLLFLVGIDRTEPKVLCSIIAGALHYLYLAAFTWMLLEGVHLFLTARNLTVVNYSSINRLMKWIMFPVGYGVPAVTVAISAASWPHLYGTADRCWLHLDQGFMWSFLGPVCAIFSANLVLFILVFWILKRKLSSLNSEVSTIQNTRMLAFKATAQLFILGCTWCLGLLQVGPAAQVMAYLFTIINSLQGFFIFLVYCLLSQQVQKQYQKWFREIVKSKSESETYTLSSKMGPDSKPSEGDVFPGQVKRKY

SEQ ID NO: 1264 - protein, 481 aa, homo sapiens
MRWLWPLAVSLAVILAVGLSRVSGGAPLHLGRHRAETQEQQSRSKRGTEDEEAKGVQQYVPEEWAEYPRPIHPAGLQPTKPLVATSPNPGKDGGTPDSGQELRGNLTGAPGQRLQIQNPLYPVTESSYSAYAIMLLALVVFAVGIVGNLSVMCIVWHSYYLKSAWNSILASLALWDFLVLFFCLPIVIFNEITKQRLLGDVSCRAVPFMEVSSLGVTTFSLCALGIDRFHVATSTLPKVRPIERCQSILAKLAVIWVGSMTLAVPELLLWQLAQEPAPTMGTLDSCIMKPSASLPESLYSLVMTYQNARMWWYFGCYFCLPILFTVTCQLVTWRVRGPPGRKSECRASKHEQCESQLNSTVVGLTVVYAFCTLPENVCNIVVAYLSTELTRQTLDLLGLINQFSTFFKGAITPVLLLCICRPLGQAFLDCCCCCCCEECGGASEASAANGSDNKLKTEVSSSIYFHKPRESPPLLPLGTPC

SEQ ID NO: 1265 - protein, 353 aa, homo sapiens
MGSLYSEYLNPNKVQEHYNYTKETLETQETTSRQVASAFIVILCCAIVVENLLVLIAVARNSKFHSAMYLFLGNLAASDLLAGVAFVANTLLSGSVTLRLTPVQWFAREGSAFITLSASVFSLLAIAIERHVAIAKVKLYGSDKSCRMLLLIGASWLISLVLGGLPILGWNCLGHLEACSTVLPLYAKHYVLCVVTIFSIILLAIVALYVRIYCVVRSSHADMAAPQTLALLKTVTIVLGVFIVCWLPAFSILLLDYACPVHSCPILYKAHYFFAVSTLNSLLNPVIYTWRSRDLRREVLRPLQCWRPGVGVQGRRRGGTPGHHLLPLRSSSSLERGMHMPTSPTFLEGNTVV

SEQ ID NO: 1266 - protein, 642 aa, homo sapiens
MTHILLLYYLVFLLPTESCRTLYQAASKSKEKVPARPHGVCDGVCTDYSQCTQPCPPDTQGNMGFSCRQKTWHKITDTCQTLNALNIFEEDSRLVQPFEDNIKISVYTGKSETITDMLLQKCPTDLSCVIRNIQQSPWIPGNIAVIVQLLHNISTAIWTGVDEAKMQSYSTIANHILNSKSISNWTFIPDRNSSYILLHSVNSFARRLFIDKHPVDISDVFIHTMGTTISGDNIGKNFTFSMRINDTSNEVTGRVLISRDELRKVPSPSQVISIAFPTIGAILEASLLENVTVNGLVLSAILPKELKRISLIFEKISKSEERRTQCVGWHSVENRWDQQACKMIQENSQQAVCKCRPSKLFTSFSILMSPHILESLILTYITYVGLGISICSLILCLSIEVLVWSQVTKTEITYLRHVCIVNIAATLLMADVWFIVASFLSGPITHHKGCVAATFFVHFFYLSVFFWMLAKALLILYGIMIVFHTLPKSVLVASLFSVGYGCPLAIAAITVAATEPGKGYLRPEICWLNWDMTKALLAFVIPALAIVVVNLITVTLVIVKTQRAAIGNSMFQEVRAIVRISKNIAILTPLLGLTWGFGVATVIDDRSLAFHIIFSLLNAFQGFFILVFGTILDPKIREALKG

SEQ ID NO: 1267 - protein, 873 aa, homo sapiens
MTTRKLSAHSAATPGYKAVTHKHHTGWARMAKTGLPEKGQSQAGGESGSGQLLDQENGAGESALVSVYVHLDFPDKTWPPELSRTLTLPAASASSSPRPLLTGLRLTTGEYMSCFEAQGFKWNLYEVVRVPLKATDVARLPYQLSISCATSPGFQLSCCIPSTNLAYTAAWSPGEGSKASSFNESGSQCFVLAVQRCPMADTTYACDLQSLGLAPLRVPISITIIQDGDITCPEDASVLTWNVTKAGHVAQAPCPESKRGIVRRLCGADGVWGPVHSSCTDARLLALFTRTKLLQAGQGSPAEEVPQILAQLPGQAAEASSPSDLLTLLSTMKYVAKVVAEARIQLDRRALKNLLIATDKVLDMDTRSLWTLAQARKPWAGSTLLLAVETLACSLCPQDHPFAFSLPNVLLQSQLFGPTFPADYSISFPTRPPLQAQIPRHSLAPLVRNGTEISITSLVLRKLDHLLPSNYGQGLGDSLYATPGLVLVISIMAGDRAFSQGEVIMDFGNTDGSPHCVFWDHSLFQGRGGWSKEGCQAQVASASPTAQCLCQHLTAFSVLMSPHTVPEEPALALLTQVGLGASILALLVCLGVYWLVWRVVVRNKISYFRHAALLNMVFCLLAADTCFLGAPFLSPGPRSPLCLAAAFLCHFLYLATFFWMLAQALVLAHQLLFVFHQLAKHRVLPLMVLLGYLCPLGLAGVTLGLYLPQGQYLREGECWLDGKGGALYTFVGPVLAIIGVNGLVLAMAMLKLLRPSLSEGPPAEKRQALLGVIKALLILTPIFGLTWGLGLATLLEEVSTVPHYIFTILNTLQGVFILLFGCLMDRKIQEALRKRFCRAQAPSSTISLATNEGCILEHSKGGSDTARKTDASE

SEQ ID NO: 1268 - protein, 560 aa, homo sapiens
MDLKTVLSLPRYPGEFLHPVVYACTAVMLLCLLASFVTYIVHQSAIRISRKGRHTLLNFCFHAALTFTVFAGGINRTKYPILCQAVGIVLHYSTLSTMLWIGVTARNIYKQVTKKAPLCLDTDQPPYPRQPLLRFYLVSGGVPFIICGVTAATNIRNYGTEDEDTAYCWMAWEPSLGAFYGPAAIITLVTCVYFLGTYVQLRRHPGRRYELRTQPEEQRRLATPEGGRGIRPGTPPAHDAPGASVLQNEHSFQAQLRAAAFTLFLFTATWAFGALAVSQGHFLDMVFSCLYGAFCVTLGLFVLIHHCAKREDVWQCWWACCPPRKDAHPALDANGAALGRAACLHSPGLGQPRGFAHPPGPCKMTNLQAAQGHASCLSPATPCCAKMHCEPLTADEAHVHLQEEGAFGHDPHLHGCLQGRTKPPYFSRHPAEEPEYAYHIPSSLDGSPRSSRTDSPPSSLDGPAGTHTLACCTQGDPFPMVTQPEGSDGSPALYSCPTQPGREAALGPGHLEMLRRTQSLPFGGPSQNGLPKGKLLEGLPFGTDGTGNIRTGPWKNETTV

SEQ ID NO: 1269 - protein, 3312 aa, homo sapiens
MMARRPPWRGLGGRSTPILLLLLLSLFPLSQEELGGGGHQGWDPGLAATTGPRAHIGGGALALCPESSGVREDGGPGLGVREPIFVGLRGRRQSARNSRGPPEQPNEELGIEHGVQPLGSRERETGQGPGSVLYWRPEVSSCGRTGPLQRGSLSPGALSSGVPGSGNSSPLPSDFLIRHHGPKPVSSQRNAGTGSRKRVGTARCCGELWATGSKGQGERATTSGAERTAPRRNCLPGASGSGPELDSAPRTARTAPASGSAPRESRTAPEPAPKRMRSRGLFRCRFLPQRPGPRPPGLPARPEARKVTSANRARFRRAANRHPQFPQYNYQTLVPENEAAGTAVLRVVAQDPDAGEAGRLVYSLAALMNSRSLELFSIDPQSGLIRTAAALDRESMERHYLRVTAQDHGSPRLSATTMVAVTVADRNDHSPVFEQAQYRETLRENVEEGYPILQLRATDGDAPPNANLRYRFVGPPAARAAAAAAFEIDPRSGLISTSGRVDREHMESYELVVEASDQGQEPGPRSATVRVHITVLDENDNAPQFSEKRYVAQVREDVRPHTVVLRVTATDRDKDANGLVHYNIISGNSRGHFAIDSLTGEIQVVAPLDFEAEREYALRIRAQDAGRPPLSNNTGLASIQVVDINDHIPIFVSTPFQVSVLENAPLGHSVIHIQAVDADHGENARLEYSLTGVAPDTPFVINSATGWVSVSGPLDRESVEHYFFGVEARDHGSPPLSASASVTVTVLDVNDNRPEFTMKEYHLRLNEDAAVGTSVVSVTAVDRDANSAISYQITGGNTRNRFAISTQGGVGLVTLALPLDYKQERYFKLVLTASDRALHDHCYVHINITDANTHRPVFQSAHYSVSVNEDRPMGSTIVVISASDDDVGENARITYLLEDNLPQFRIDADSGAITLQAPLDYEDQVTYTLAITARDNGIPQKADTTYVEVMVNDVNDNAPQFVASHYTGLVSEDAPPFTSVLQISATDRDAHANGRVQYTFQNGEDGDGDFTIEPTSGIVRTVRRLDREAVSVYELTAYAVDRGVPPLRTPVSIQVMVQDVNDNAPVFPAEEFEVRVKENSIVGSVVAQITAVDPDEGPNAHIMYQIVEGNIPELFQMDIFSGELTALIDLDYEARQEYVIVVQATSAPLVSRATVHVRLVDQNDNSPVLNNFQILFNNYVSNRSDTFPSGIIGRIPAYDPDVSDHLFYSFERGNELQLLVVNQTSGELRLSRKLDNNRPLVASMLVTVTDGLHSVTAQCVLRVVIITEELLANSLTVRLENMWQERFLSPLLGRFLEGVAAVLATPAEDVFIFNIQNDTDVGGTVLNVSFSALAPRGAGAGAAGPWFSSEELQEQLYVRRAALAARSLLDVLPFDDNVCLREPCENYMKCVSVLRFDSSAPFLASASTLFRPIQPIAGLRCRCPPGFTGDFCETELDLCYSNPCRNGGACARREGGYTCVCRPRFTGEDCELDTEAGRCVPGVCRNGGTCTDAPNGGFRCQCPAGGAFEGPRCEVAARSFPPSSFVMFRGLRQRFHLTLSLSFATVQQSGLLFYNGRLNEKHDFLALELVAGQVRLTYSTGESNTVVSPTVPGGLSDGQWHTVHLRYYNKPRTDALGGAQGPSKDKVAVLSVDDCDVAVALQFGAEIGNYSCAAAGVQTSSKKSLDLTGPLLLGGVPNLPENFPVSHKDFIGCMRDLHIDGRRVDMAAFVANNGTMAGCQAKLHFCDSGPCKNSGFCSERWGSFSCDCPVGFGGKDCQLTMAHPHHFRGNGTLSWNFGSDMAVSVPWYLGLAFRTRATQGVLMQVQAGPHSTLLCQLDRGLLSVTVTRGSGRASHLLLDQVTVSDGRWHDLRLELQEEPGGRRGHHVLMVSLDFSLFQDTMAVGSELQGLKVKQLHVGGLPPGSAEEAPQGLVGCIQGVWLGSTPSGSPALLPPSHRVNAEPGCVVTNACASGPCPPHADCRDLWQTFSCTCQPGYYGPGCVDACLLNPCQNQGSCRHLPGAPHGYTCDCVGGYFGHHCEHRMDQQCPRGWWGSPTCGPCNCDVHKGFDPNCNKTNGQCHCKEFHYRPRGSDSCLPCDCYPVGSTSRSCAPHSGQCPCRPGALGRQCNSCDSPFAEVTASGCRVLYDACPKSLRSGVWWPQTKFGVLATVPCPRGALGAAVRLCDEAQGWLEPDLFNCTSPAFRELSLLLDGLELNKTALDTMEAKKLAQRLREVTGHTDHYFSQDVRVTARLLAHLLAFESHQQGFGLTATQDAHFNENLLWAGSALLAPETGDLWAALGQRAPGGSPGSAGLVRHLEEYAATLARNMELTYLNPMGLVTPNIMLSIDRMEHPSSPRGARRYPRYHSNLFRGQDAWDPHTHVLLPSQSPRPSPSEVLPTSSSIENSTTSSVVPPPAPPEPEPGISIIILLVYRTLGGLLPAQFQAERRGARLPQNPVMNSPVVSVAVFHGRNFLRGILESPISLEFRLLQTANRSKAICVQWDPPGLAEQHGVWTARDCELVHRNGSHARCRCSRTGTFGVLMDASPRERLEGDLELLAVFTHVVVAVSVAALVLTAAILLSLRSLKSNVRGIHANVAAALGVAELLFLLGIHRTHNQLVCTAVAILLHYFFLSTFAWLFVQGLHLYRMQVEPRNVDRGAMRFYHALGWGVPAVLLGLAVGLDPEGYGNPDFCWISVHEPLIWSFAGPVVLVIVMNGTMFLLAARTSCSTGQREAKKTSALTLRSSFLLLLLVSASWLFGLLAVNHSILAFHYLHAGLCGLQGLAVLLLFCVLNADARAAWMPACLGRKAAPEEARPAPGLGPGAYNNTALFEESGLIRITLGASTVSSVSSARSGRTQDQDSQRGRSYLRDNVLVRHGSAADHTDHSLQAHAGPTDLDVAMFHRDAGADSDSDSDLSLEEERSLSIPSSESEDNGRTRGRFQRPLCRAAQSERLLTHPKDVDGNDLLSYWPALGECEAAPCALQTWGSERRLGLDTSKDAANNNQPDPALTSGDETSLGRAQRQRKGILKNRLQYPLVPQTRGAPELSWCRAATLGHRAVPAASYGRIYAGGGTGSLSQPASRYSSREQLDLLLRRQLSRERLEEAPAPVLRPLSRPGSQECMDAAPGRLEPKDRGSTLPRRQPPRDYPGAMAGRFGSRDALDLGAPREWLSTLPPPRRTRDLDPQPPPLPLSPQRQLSRDPLLPSRPLDSLSRSSNSREQLDQVPSRHPSREALGPLPQLLRAREDSVSGPSHGPSTEQLDILSSILASFNSSALSSVQSSSTPLGPHTTATPSATASVLGPSTPRSATSHSISELSPDSEVPRSEGHS

SEQ ID NO: 1270 - protein, 368 aa, homo sapiens
MANSTGLNASEVAGSLGLILAAVVEVGALLGNGALLVVVLRTPGLRDALYLAHLCVVDLLAAASIMPLGLLAAPPPGLGRVRLGPAPCRAARFLSAALLPACTLGVAALGLARYRLIVHPLRPGSRPPPVLVLTAVWAAAGLLGALSLLGTPPAPPPAPARCSVLAGGLGPFRPLWALLAFALPALLLLGAYGGIFVVARRAALRPPRPARGSRLHSDSLDSRLSILPPLRPRLPGGKAALAPALAVGQFAACWLPYGCACLAPAARAAEAEAAVTWVAYSAFAAHPFLYGLLQRPVRLALGRLSRRALPGPVRACTPQAWHPRALLQCLQRPPEGPAVGPSEAPEQTPELAGGRSPAYQGPPESSLS

SEQ ID NO: 1271 - protein, 343 aa, homo sapiens
MAGNCSWEAHPGNRNKMCPGLSEAPELYSRGFLTIEQIAMLPPPAVMNYIFLLLCLCGLVGNGLVLWFFGFSIKRNPFSIYFLHLASADVGYLFSKAVFSILNTGGFLGTFADYIRSVCRVLGLCMFLTGVSLLPAVSAERCASVIFPAWYWRRRPKRLSAVVCALLWVLSLLVTCLHNYFCVFLGRGAPGAACRHMDIFLGILLFLLCCPLMVLPCLALILHVECRARRRQRSAKLNHVILAMVSVFLVSSIYLGIDWFLFWVFQIPAPFPEYVTDLCICINSSAKPIVYFLAGRDKSQRLWEPLRVVFQRALRDGAELGEAGGSTPNTVTMEMQCPPGNAS

SEQ ID NO: 1272 - protein, 1346 aa, homo sapiens
MKSPRRTTLCLMFIVIYSSKAALNWNYESTIHPLSLHEHEPAGEEALRQKRAVATKSPTAEEYTVNIEISFENASFLDPIKAYLNSLSFPIHGNNTDQITDILSINVTTVCRPAGNEIWCSCETGYGWPRERCLHNLICQERDVFLPGHHCSCLKELPPNGPFCLLQEDVTLNMRVRLNVGFQEDLMNTSSALYRSYKTDLETAFRKGYGILPGFKGVTVTGFKSGSVVVTYEVKTTPPSLELIHKANEQVVQSLNQTYKMDYNSFQAVTINESNFFVTPEIIFEGDTVSLVCEKEVLSSNVSWRYEEQQLEIQNSSRFSIYTALFNNMTSVSKLTIHNITPGDAGEYVCKLILDIFEYECKKKIDVMPIQILANEEMKVMCDNNPVSLNCCSQGNVNWSKVEWKQEGKINIPGTPETDIDSSCSRYTLKADGTQCPSGSSGTTVIYTCEFISAYGARGSANIKVTFISVANLTITPDPISVSEGQNFSIKCISDVSNYDEVYWNTSAGIKIYQRFYTTRRYLDGAESVLTVKTSTREWNGTYHCIFRYKNSYSIATKDVIVHPLPLKLNIMVDPLEATVSCSGSHHIKCCIEEDGDYKVTFHTGSSSLPAAKEVNKKQVCYKHNFNASSVSWCSKTVDVCCHFTNAANNSVWSPSMKLNLVPGENITCQDPVIGVGEPGKVIQKLCRFSNVPSSPESPIGGTITYKCVGSQWEEKRNDCISAPINSLLQMAKALIKSPSQDEMLPTYLKDLSISIDKAEHEISSSPGSLGAIINILDLLSTVPTQVNSEMMTHVLSTVNVILGKPVLNTWKVLQQQWTNQSSQLLHSVERFSQALQSGDSPPLSFSQTNVQMSSMVIKSSHPETYQQRFVFPYFDLWGNVVIDKSYLENLQSDSSIVTMAFPTLQAILAQDIQENNFAESLVMTTTVSHNTTMPFRISMTFKNNSPSGGETKCVFWNFRLANNTGGWDSSGCYVEEGDGDNVTCICDHLTSFSILMSPDSPDPSSLLGILLDIISYVGVGFSILSLAACLVVEAVVWKSVTKNRTSYMRHTCIVNIAASLLVANTWFIVVAAIQDNRYILCKTACVAATFFIHFFYLSVFFWMLTLGLMLFYRLVFILHETSRSTQKAIAFCLGYGCPLAISVITLGATQPREVYTRKNVCWLNWEDTKALLAFAIPALIIVVVNITITIVVITKILRPSIGDKPCKQEKSSLFQISKSIGVLTPLLGLTWGFGLTTVFPGTNLVFHIIFAILNVFQGLFILLFGCLWDLKVQEALLNKFSLSRWSSQHSKSTSLGSSTPVFSMSSPISRRFNNLFGKTGTYNVSTPEATSSSLENSSSASSLLN

SEQ ID NO: 1273 - protein, 690 aa, homo sapiens
MKRLPLLVVFSTLLNCSYTQNCTKTPCLPNAKCEIRNGIEACYCNMGFSGNGVTICEDDNECGNLTQSCGENANCTNTEGSYYCMCVPGFRSSSNQDRFITNDGTVCIENVNANCHLDNVCIAANINKTLTKIRSIKEPVALLQEVYRNSVTDLSPTDIITYIEILAESSSLLGYKNNTISAKDTLSNSTLTEFVKTVNNFVQRDTFVVWDKLSVNHRRTHLTKLMHTVEQATLRISQSFQKTTEFDTNSTDIALKVFFFDSYNMKHIHPHMNMDGDYINIFPKRKAAYDSNGNVAVAFVYYKSIGPLLSSSDNFLLKPQNYDNSEEEERVISSVISVSMSSNPPTLYELEKITFTLSHRKVTDRYRSLCAFWNYSPDTMNGSWSSEGCELTYSNETHTSCRCNHLTHFAILMSSGPSIGIKDYNILTRITQLGIIISLICLAICIFTFWFFSEIQSTRTTIHKNLCCSLFLAELVFLVGINTNTNKLFCSIIAGLLHYFFLAAFAWMCIEGIHLYLIVVGVIYNKGFLHKNFYIFGYLSPAVVVGFSAALGYRYYGTTKVCWLSTENNFIWSFIGPACLIILVNLLAFGVIIYKVFRHTAGLKPEVSCFENIRSCARGALALLFLLGTTWIFGVLHVVHASVVTAYLFTVSNAFQGMFIFLFLCVLSRKIQEEYYRLFKNVPCCFGCLR

SEQ ID NO: 1274 - protein, 388 aa, homo sapiens
MSAPSTLPPGGEEGLGTAWPSAANASSAPAEAEEAVAGPGDARAAGMVAIQCIYALVCLVGLVGNALVIFVILRYAKMKTATNIYLLNLAVADELFMLSVPFVASSAALRHWPFGSVLCRAVLSVDGLNMFTSVFCLTVLSVDRYVAVVHPLRAATYRRPSVAKLINLGVWLASLLVTLPIAIFADTRPARGGQAVACNLQWPHPAWSAVFVVYTFLLGFLLPVLAIGLCYLLIVGKMRAVALRAGWQQRRRSEKKITRLVLMVVVVFVLCWMPFYVVQLLNLFVTSLDATVNHVSLILSYANSCANPILYGFLSDNFRRFFQRVLCLRCCLLEGAGGAEEEPLDYYATALKSKGGAGCMCPPLPCQQEALQPEPGRKRIPLTRTTTF

SEQ ID NO: 1275 - protein, 617 aa, homo sapiens
MGPTLAVPTPYGCIGCKLPQPEYPPALIIFMFCAMVITIVVDLIGNSMVILAVTKNKKLRNSGNIFVVSLSVADMLVAIYPYPLMLHAMSIGGWDLSQLQCQMVGFITGLSVVGSIFNIVAIAINRYCYICHSLQYERIFSVRNTCIYLVITWIMTVLAVLPNMYIGTIEYDPRTYTCIFNYLNNPVFTVTIVCIHFVLPLLIVGFCYVRIWTKVLAARDPAGQNPDNQLAEVRNFLTMFVIFLLFAVCWCPINVLTVLVAVSPKEMAGKIPNWLYLAAYFIAYFNSCLNAVIYGLLNENFRREYWTIFHAMRHPIIFFSGLISDIREMQEARTLARARAHARDQAREQDRAHACPAVEETPMNVRNVPLPGDAAAGHPDRASGHPKPHSRSSSAYRKSASTHHKSVFSHSKAASGHLKPVSGHSKPASGHPKSATVYPKPASVHFKADSVHFKGDSVHFKPDSVHFKPASSNPKPITGHHVSAGSHSKSAFSAATSHPKPTTGHIKPATSHAEPTTADYPKPATTSHPKPTAADNPELSASHCPEIPAIAHPVSDDSDLPESASSPAAGPTKPAASQLESDTIADLPDPTVVTTSTNDYHDVVVIDVEDDPDEMAV

SEQ ID NO: 1276 - protein, 395 aa, homo sapiens
MSANATLKPLCPILEQMSRLQSHSNTSIRYIDHAAVLLHGLASLLGLVENGVILFVVGCRMRQTVVTTWVLHLALSDLLASASLPFFTYFLAVGHSWELGTTFCKLHSSIFFLNMFASGFLLSAISLDRCLQVVRPVWAQNHRTVAAAHKVCLVLWALAVLNTVPYFVFRDTISRLDGRIMCYYNVLLLNPGPDRDATCNSRQVALAVSKFLLAFLVPLAIIASSHAAVSLRLQHRGRRRPGRFVRLVAAVVAAFALCWGPYHVFSLLEARAHANPGLRPLVWRGLPFVTSLAFFNSVANPVLYVLTCPDMLRKLRRSLRTVLESVLVDDSELGGAGSSRRRRTSSTARSASPLALCSRPEEPRGPARLLGWLLGSCAASPQTGPLNRALSSTSS

SEQ ID NO: 1277 - protein, 319 aa, homo sapiens
MPFPNCSAPSTVVATAVGVLLGLECGLGLLGNAVALWTFLFRVRVWKPYAVYLLNLALADLLLAACLPFLAAFYLSLQAWHLGRVGCWALHFLLDLSRSVGMAFLAAVALDRYLRVVHPRLKVNLLSPQAALGVSGLVWLLMVALTCPGLLISEAAQNSTRCHSFYSRADGSFSIIWQEALSCLQFVLPFGLIVFCNAGIIRALQKRLREPEKQPKLQRAQALVTLVVVLFALCFLPCFLARVLMHIFQNLGSCRALCAVAHTSDVTGSLTYLHSVLNPVVYCFSSPTFRSSYRRVFHTLRGKGQAAEPPDFNPRDSYS

SEQ ID NO: 1278 - protein, 362 aa, homo sapiens
MGTEATEQVSWGHYSGDEEDAYSAEPLPELCYKADVQAFSRAFQPSVSLTVAALGLAGNGLVLATHLAARRAARSPTSAHLLQLALADLLLALTLPFAAAGALQGWSLGSATCRTISGLYSASFHAGFLFLACISADRYVAIARALPAGPRPSTPGRAHLVSVIVWLLSLLLALPALLFSQDGQREGQRRCRLIFPEGLTQTVKGASAVAQVALGFALPLGVMVACYALLGRTLLAARGPERRRALRVVVALVAAFVVLQLPYSLALLLDTADLLAARERSCPASKRKDVALLVTSGLALARCGLNPVLYAFLGLRFRQDLRRLLRGGSCPSGPQPRRGCPRRPRLSSCSAPTETHSLSWDN

SEQ ID NO: 1279 - protein, 375 aa, homo sapiens
MNTSHLLALLLPKSPQGENRSKPLGTPYNFSEHCQDSVDVMVFIVTSYSIETVVGVLGNLCLMCVTVRQKEKANVTNLLIANLAFSDFLMCLLCQPLTAVYTIMDYWIFGETLCKMSAFIQCMSVTVSILSLVLVALERHQLIINPTGWKPSISQAYLGIVLIWVIACVLSLPFLANSILENVFHKNHSKALEFLADKVVCTESWPLAHHRTIYTTFLLLFQYCLPLGFILVCYARIYRRLQRQGRVFHKGTYSLRAGHMKQVNVVLVVMVVAFAVLWLPLHVFNSLEDWHHEAIPICHGNLIFLVCHLLAMASTCVNPFIYGFLNTNFKKEIKALVLTCQQSAPLEESEHLPLSTVHTEVSKGSLRLSGRSNPI

SEQ ID NO: 1280 - protein, 398 aa, homo sapiens
MGTCDIVTEANISSGPESNTTGITAFSMPSWQLALWATAYLALVLVAVTGNAIVIWIILAHRRMRTVTNYFIVNLALADLCMAAFNAAFNFVYASHNIWYFGRAFCYFQNLFPITAMFVSIYSMTAIAADRYMAIVHPFQPRLSAPSTKAVIAGIWLVALALASPQCFYSTVTMDQGATKCVVAWPEDSGGKTLLLYHLVVIALIYFLPLAVMFVAYSVIGLTLWRRAVPGHQAHGANLRHLQAMKKFVKTMVLVVLTFAICWLPYHLYFILGSFQEDIYCHKFIQQVYLALFWLAMSSTMYNPIIYCCLNHRFRSGFRLAFRCCPWVTPTKEDKLELTPTTSLSTRVNRCHTKETLFMAGDTAPSEATSGEAGRPQDGSGLWFGYGLLAPTKTHVEI

SEQ ID NO: 1281 - protein, 1232 aa, homo sapiens
MANGVIPPPGGASPLPQVRVPLEEPPLSPDVEEEDDDLGKTLAVSRFGDLISKPPAWDPEKPSRSYSERDFEFHRHTSHHTHHPLSARLPPPHKLRRLPPTSARHTRRKRKKEKTSAPPSEGTPPIQEEGGAGVDEEEEEEEEEEGESEAEPVEPPPSGTPQKAKFSIGSDEDDSPGLPGRAAVTKPLPSVGPHTDKSPQHSSSSPSPRARASRLAGEKSRPWSPSASYDLRERLCPGSALGNPGGPEQQVPTDEAEAQMLGSADLDDMKSHRLEDNPGVRRHLVKKPSRTQGGRGSPSGLAPILRRKKKKKKLDRRPHEVFVELNELMLDRSQEPHWRETARWIKFEEDVEEETERWGKPHVASLSFRSLLELRRTIAHGAALLDLEQTTLPGIAHLVVETMIVSDQIRPEDRASVLRTLLLKHSHPNDDKDSGFFPRNPSSSSMNSVLGNHHPTPSHGPDGAVPTMADDLGEPAPLWPHDPDAKEKPLHMPGGDGHRGKSLKLLEKIPEDAEATVVLVGCVPFLEQPAAAFVRLNEAVLLESVLEVPVPVRFLFVMLGPSHTSTDYHELGRSIATLMSDKLFHEAAYQADDRQDLLSAISEFLDGSIVIPPSEVEGRDLLRSVAAFQRELLRKRREREQTKVEMTTRGGYTAPGKELSLELGGSEATPEDDPLLRTGSVFGGLVRDVRRRYPHYPSDLRDALHSQCVAAVLFIYFAALSPAITFGGLLGEKTEGLMGVSELIVSTAVLGVLFSLLGAQPLLVVGFSGPLLVFEEAFFKFCRAQDLEYLTGRVWVGLWLVVFVLALVAAEGSFLVRYISPFTQEIFAFLISLIFIYETFYKLYKVFTEHPLLPFYPPEGALEGSLDAGLEPNGSALPPTEGPPSPRNQPNTALLSLILMLGTFFIAFFLRKFRNSRFLGGKARRIIGDFGIPISILVMVLVDYSITDTYTQKLTVPTGLSVTSPDKRSWFIPPLGSARPFPPWMMVAAAVPALLVLILIFMETQITALIVSQKARRLLKGSGFHLDLLLIGSLGGLCGLFGLPWLTAATVRSVTHVNALTVMRTAIAPGDKPQIQEVREQRVTGVLIASLVGLSIVMGAVLRRIPLAVLFGIFLYMGVTSLSGIQLSQRLLLILMPAKHHPEQPYVTKVKTWRMHLFTCIQLGCIALLWVVKSTAASLAFPFLLLLTVPLRHCLLPRLFQDRELQALDSEDAEPNFDEDGQDEYNELHMPV

SEQ ID NO: 1282 - protein, 951 aa, homo sapiens
MPGPLGLLCFLALGLLGSAGPSGAAPPLCAAPCSCDGDRRVDCSGKGLTAVPEGLSAFTQALDISMNNITQLPEDAFKNFPFLEELQLAGNDLSFIHPKALSGLKELKVLTLQNNQLKTVPSEAIRGLSALQSLRLDANHITSVPEDSFEGLVQLRHLWLDDNSLTEVPVHPLSNLPTLQALTLALNKISSIPDFAFTNLSSLVVLHLHNNKIRSLSQHCFDGLDNLETLDLNYNNLGEFPQAIKALPSLKELGFHSNSISVIPDGAFDGNPLLRTIHLYDNPLSFVGNSAFHNLSDLHSLVIRGASMVQQFPNLTGTVHLESLTLTGTKISSIPNNLCQEQKMLRTLDLSYNNIRDLPSFNGCHALEEISLQRNQIYQIKEGTFQGLISLRILDLSRNLIHEIHSRAFATLGPITNLDVSFNELTSFPTEGLNGLNQLKLVGNFKLKEALAAKDFVNLRSLSVPYAYQCCAFWGCDSYANLNTEDNSLQDHSVAQEKGTADAANVTSTLENEEHSQIIIHCTPSTGAFKPCEYLLGSWMIRLTVWFIFLVALFFNLLVILTTFASCTSLPSSKLFIGLISVSNLFMGIYTGILTFLDAVSWGRFAEFGIWWETGSGCKVAGFLAVFSSESAIFLLMLATVERSLSAKDIMKNGKSNHLKQFRVAALLAFLGATVAGCFPLFHRGEYSASPLCLPFPTGETPSLGFTVTLVLLNSLAFLLMAVIYTKLYCNLEKEDLSENSQSSMIKHVAWLIFTNCIFFCPVAFFSFAPLITAISISPEIMKSVTLIFFPLPACLNPVLYVFFNPKFKEDWKLLKRRVTKKSGSVSVSISSQGGCLEQDFYYDCGMYSHLQGNLTVCDCCESFLLTKPVSCKHLIKSHSCPALAVASCQRPEGYWSDCGTQSAHSDYADEEDSFVSDSSDQVQACGRACFYQSRGFPLVRYAYNLPRVKD

SEQ ID NO: 1283 - protein, 431 aa, homo sapiens
MQALNITPEQFSRLLRDHNLTREQFIALYRLRPLVYTPELPGRAKLALVLTGVLIFALALFGNALVFYVVTRSKAMRTVTNIFICSLALSDLLITFFCIPVTMLQNISDNWLGGAFICKMVPFVQSTAVVTEILTMTCIAVERHQGLVHPFKMKWQYTNRRAFTMLGVVWLVAVIVGSPMWHVQQLEIKYDFLYEKEHICCLEEWTSPVHQKIYTTFILVILFLLPLMVMLILYSKIGYELWIKKRVGDGSVLRTIHGKEMSKIARKKKRAVIMMVTVVALFAVCWAPFHVVHMMIEYSNFEKEYDDVTIKMIFAIVQIIGFSNSICNPIVYAFMNENFKKNVLSAVCYCIVNKTFSPAQRHGNSGITMMRKKAKFSLRENPVEETKGEAFSDGNIEVKLCEQTEEKKKLKRHLALFRSELAENSPLDSGH

SEQ ID NO: 1284 - protein, 387 aa, homo sapiens
MNRHHLQDHFLEIDKKNCCVFRDDFIAKVLPPVLGLEFIFGLLGNGLALWIFCFHLKSWKSSRIFLFNLAVADFLLIICLPFVMDYYVRRSDWKFGDIPCRLVLFMFAMNRQGSIIFLTVVAVDRYFRVVHPHHALNKISNWTAAIISCLLWGITVGLTVHLLKKKLLIQNGTANVCISFSICHTFRWHEAMFLLEFFLPLGIILFCSARIIWSLRQRQMDRHAKIKRAITFIMVVAIVFVICFLPSVVVRIHIFWLLHTSGTQNCEVYRSVDLAFFITLSFTYMNSMLDPVVYYFSSPSFPNFFSTLINRCLQRKITGEPDNNRSTSVELTGDPNKTRGAPEALIANSGEPWSPSYLGPTSNNHSKKGHCHQEPASLEKQLGCCIE

SEQ ID NO: 1285 - protein, 390 aa, homo sapiens
MPSKSLSNLSVTTGANESGSVPEGWERDFLPASDGTTTELVIRCVIPSLYLLIITVGLLGNIMLVKIFITNSAMRSVPNIFISNLAAGDLLLLLTCVPVDASRYFFDEWMFGKVGCKLIPVIQLTSVGVSVFTLTALSADRYRAIVNPMDMQTSGALLRTCVKAMGIWVVSVLLAVPEAVFSEVARISSLDNSSFTACIPYPQTDELHPKIHSVLIFLVYFLIPLAIISIYYYHIAKTLIKSAHNLPGEYNEHTKKQMETRKRLAKIVLVFVGCFIFCWFPNHILYMYRSFNYNEIDPSLGHMIVTLVARVLSFGNSCVNPFALYLLSESFRRHFNSQLCCGRKSYQERGTSYLLSSSAVRMTSLKSNAKNMVTNSVLLNGHSMKQEMAL

SEQ ID NO: 1286 - protein, 1469 aa, homo sapiens
MWPSQLLIFMMLLAPIIHAFSRAPIPMAVVRRELSCESYPIELRCPGTDVIMIESANYGRTDDKICDSDPAQMENIRCYLPDAYKIMSQRCNNRTQCAVVAGPDVFPDPCPGTYKYLEVQYECVPYKVEQKVFLCPGLLKGVYQSEHLFESDHQSGAWCKDPLQASDKIYYMPWTPYRTDTLTEYSSKDDFIAGRPTTTYKLPHRVDGTGFVVYDGALFFNKERTRNIVKFDLRTRIKSGEAIIANANYHDTSPYRWGGKSDIDLAVDENGLWVIYATEQNNGKIVISQLNPYTLRIEGTWDTAYDKRSASNAFMICGILYVVKSVYEDDDNEATGNKIDYIYNTDQSKDSLVDVPFPNSYQYIAAVDYNPRDNLLYVWNNYHVVKYSLDFGPLDSRSGQAHHGQVSYISPPIHLDSELERPSVKDISTTGPLGMGSTTTSTTLRTTTLSPGRSTTPSVSGRRNRSTSTPSPAVEVLDDMTTHLPSASSQIPALEESCEAVEAREIMWFKTRQGQIAKQPCPAGTIGVSTYLCLAPDGIWDPQGPDLSNCSSPWVNHITQKLKSGETAANIARELAEQTRNHLNAGDITYSVRAMDQLVGLLDVQLRNLTPGGKDSAARSLNKLQKRERSCRAYVQAMVETVNNLLQPQALNAWRDLTTSDQLRAATMLLHTVEESAFVLADNLLKTDIVRENTDNIKLEVARLSTEGNLEDLKFPENMGHGSTIQLSANTLKQNGRNGEIRVAFVLYNNLGPYLSTENASMKLGTEALSTNHSVIVNSPVITAAINKEFSNKVYLADPVVFTVKHIKQSEENFNPNCSFWSYSKRTMTGYWSTQGCRLLTTNKTHTTCSCNHLTNFAVLMAHVEVKHSDAVHDLLLDVITWVGILLSLVCLLICIFTFCFFRGLQSDRNTIHKNLCISLFVAELLFLIGINRTDQPIACAVFAALLHFFFLAAFTWMFLEGVQLYIMLVEVFESEHSRRKYFYLVGYGMPALIVAVSAAVDYRSYGTDKVCWLRLDTYFIWSFIGPATLIIMLNVIFLGIALYKMFHHTAILKPESGCLDNINYEDNRPFIKSWVIGAIALLCLLGLTWAFGLMYINESTVIMAYLFTIFNSLQGMFIFIFHCVLQKKVRKEYGKCLRTHCCSGKSTESSIGSGKTSGSRTPGRYSTGSQSRIRRMWNDTVRKQSESSFITGDINSSASLNREGLLNNARDTSVMDTLPLNGNHGNSYSIASGEYLSNCVQIIDRGYNHNETALEKKILKELTSNYIPSYLNNHERSSEQNRNLMNKLVNNLGSGREDDAIVLDDATSFNHEESLGLELIHEESDAPLLPPRVYSTENHQPHHYTRRRIPQDHSESFFPLLTNEHTEDLQSPHRDSLYTSMPTLAGVAATESVTTSTQTEPPPAKCGDAEDVYYKSMPNLGSRNHVHQLHTYYQLGRGSSDGFIVPPNKDGTPPEGSSKGPAHLVTSL

SEQ ID NO: 1287 - protein, 425 aa, homo sapiens
MGPRRLLLVAACFSLCGPLLSARTRARRPESKATNATLDPRSFLLRNPNDKYEPFWEDEEKNESGLTEYRLVSINKSSPLQKQLPAFISEDASGYLTSSWLTLFVPSVYTGVFVVSLPLNIMAIVVFILKMKVKKPAVVYMLHLATADVLFVSVLPFKISYYFSGSDWQFGSELCRFVTAAFYCNMYASILLMTVISIDRFLAVVYPMQSLSWRTLGRASFTCLAIWALAIAGVVPLLLKEQTIQVPGLNITTCHDVLNETLLEGYYAYYFSAFSAVFFFVPLIISTVCYVSIIRCLSSSAVANRSKKSRALFLSAAVFCIFIICFGPTNVLLIAHYSFLSHTSTTEAAYFAYLLCVCVSSISCCIDPLIYYYASSECQRYVYSILCCKESSDPSSYNSSGQLMASKMDTCSSNLNNSIYKKLLT

SEQ ID NO: 1288 - protein, 463 aa, homo sapiens
MAGAPGPLRLALLLLGMVGRAGPRPQGATVSLWETVQKWREYRRQCQRSLTEDPPPATDLFCNRTFDEYACWPDGEPGSFVNVSCPWYLPWASSVPQGHVYRFCTAEGLWLQKDNSSLPWRDLSECEESKRGERSSPEEQLLFLYIIYTVGYALSFSALVIASAILLGFRHLHCTRNYIHLNLFASFILRALSVFIKDAALKWMYSTAAQQHQWDGLLSYQDSLSCRLVFLLMQYCVAANYYWLLVEGVYLYTLLAFSVLSEQWIFRLYVSIGWGVPLLFVVPWGIVKYLYEDEGCWTRNSNMNYWLIIRLPILFAIGVNFLIFVRVICIVVSKLKANLMCKTDIKCRLAKSTLTLIPLLGTHEVIFAFVMDEHARGTLRFIKLFTELSFTSFQGLMVAILYCFVNNEVQLEFRKSWERWRLEHLHIQRDSSMKPLKCPTSSLSSGATAGSSMYTATCQASCS

SEQ ID NO: 1289 - protein, 1194 aa, homo sapiens
MVGLLLFFFPAIFLEVSLLPRSPGRKVLLAGASSQRSVARMDGDVIIGALFSVHHQPPAEKVPERKCGEIREQYGIQRVEAMFHTLDKINADPVLLPNITLGSEIRDSCWHSSVALEQSIEFIRDSLISIRDEKDGINRCLPDGQSLPPGRTKKPIAGVIGPGSSSVAIQVQNLLQLFDIPQIAYSATSIDLSDKTLYKYFLRVVPSDTLQARAMLDIVKRYNWTYVSAVHTEGNYGESGMDAFKELAAQEGLCIAHSDKIYSNAGEKSFDRLLRKLRERLPKARVVVCFCEGMTVRGLLSAMRRLGVVGEFSLIGSDGWADRDEVIEGYEVEANGGITIKLQSPEVRSFDDYFLKLRLDTNTRNPWFPEFWQHRFQCRLPGHLLENPNFKRICTGNESLEENYVQDSKMGFVINAIYAMAHGLQNMHHALCPGHVGLCDAMKPIDGSKLLDFLIKSSFIGVSGEEVWFDEKGDAPGRYDIMNLQYTEANRYDYVHVGTWHEGVLNIDDYKIQMNKSGVVRSVCSEPCLKGQIKVIRKGEVSCCWICTACKENEYVQDEFTCKACDLGWWPNADLTGCEPIPVRYLEWSNIESIIAIAFSCLGILVTLFVTLIFVLYRDTPVVKSSSRELCYIILAGIFLGYVCPFTLIAKPTTTSCYLQRLLVGLSSAMCYSALVTKTNRIARILAGSKKKICTRKPRFMSAWAQVIIASILISVQLTLVVTLIIMEPPMPILSYPSIKEVYLICNTSNLGVVAPLGYNGLLIMSCTYYAFKTRNVPANFNEAKYIAFTMYTTCIIWLAFVPIYFGSNYKIITTCFAVSLSVTVALGCMFTPKMYIIIAKPERNVRSAFTTSDVVRMHVGDGKLPCRSNTFLNIFRRKKAGAGNANSNGKSVSWSEPGGGQVPKGQHMWHRLSVHVKTNETACNQTAVIKPLTKSYQGSGKSLTFSDTSTKTLYNVEEEEDAQPIRFSPPGSPSMVVHRRVPSAATTPPLPSHLTAEETPLFLAEPALPKGLPPPLQQQQQPPPQQKSLMDQLQGVVSNFSTAIPDFHAVLAGPGGPGNGLRSLYPPPPPPQHLQMLPLQLSTFGEELVSPPADDDDDSERFKLLQEYVYEHEREGNTEEDELEEEEEDLQAASKLTPDDSPALTPPSPFRDSVASGSSVPSSPVSESVLCTPPNVSYASVILRDYKQSSSTL

SEQ ID NO: 1290 - protein, 349 aa, homo sapiens
MELAVGNLSEGNASWPEPPAPEPGPLFGIGVENFVTLVVFGLIFALGVLGNSLVITVLARSKPGKPRSTTNLFILNLSIADLAYLLFCIPFQATVYALPTWVLGAFICKFIHYFFTVSMLVSIFTLAAMSVDRYVAIVHSRRSSSLRVSRNALLGVGCIWALSIAMASPVAYHQGLFHPRASNQTFCWEQWPDPRHKKAYVVCTFVFGYLLPLLLICFCYAKVLNHLHKKLKNMSKKSEASKKKTAQTVLVVVVVFGISWLPHHIIHLWAEFGVFPLTPASFLFRITAHCLAYSNSSVNPIIYAFLSENFRKAYKQVFKCHIRKDSHLSDTKESKSRIDTPPSTNCTHV

SEQ ID NO: 1291 - protein, 323 aa, homo sapiens
MNASCCLPSVQPTLPNGSEHLQAPFFSNQSSSAFCEQVFIKPEVFLSLGIVSLLENILVILAVVRNGNLHSPMYFFLCSLAVADMLVSVSNALETIMIAIVHSDYLTFEDQFIQHMDNIFDSMICISLVASICNLLAIAVDRYVTIFYALRYHSIMTVRKALTLIVAIWVCCGVCGVVFIVYSESKMVIVCLITMFFAMMLLMGTLYVHMFLFARLHVKRIAALPPADGVAPQQHSCMKGAVTITILLGVFIFCWAPFFLHLVLIITCPTNPYCICYTAHFNTYLVLIMCNSVIDPLIYAFRSLELRNTFREILCGCNGMNLG

SEQ ID NO: 1292 - protein, 415 aa, homo sapiens
MSGMEKLQNASWIYQQKLEDPFQKHLNSTEEYLAFLCGPRRSHFFLPVSVVYVPIFVVGVIGNVLVCLVILQHQAMKTPTNYYLFSLAVSDLLVLLLGMPLEVYEMWRNYPFLFGPVGCYFKTALFETVCFASILSITTVSVERYVAILHPFRAKLQSTRRRALRILGIVWGFSVLFSLPNTSIHGIKFHYFPNGSLVPGSATCTVIKPMWIYNFIIQVTSFLFYLLPMTVISVLYYLMALRLKKDKSLEADEGNANIQRPCRKSVNKMLFVLVLVFAICWAPFHIDRLFFSFVEEWSESLAAVFNLVHVVSGVFFYLSSAVNPIIYNLLSRRFQAAFQNVISSFHKQWHSQHDPQLPPAQRNIFLTECHFVELTEDIGPQFPCQSSMHNSHLPAALSSEQMSRTNYQSFHFNKT

SEQ ID NO: 1293 - protein, 374 aa, homo sapiens
MLSTSRSRFIRNTNESGEEVTTFFDYDYGAPCHKFDVKQIGAQLLPPLYSLVFIFGFVGNMLVVLILINCKKLKCLTDIYLLNLAISDLLFLITLPLWAHSAANEWVFGNAMCKLFTGLYHIGYFGGIFFIILLTIDRYLAIVHAVFALKARTVTFGVVTSVITWLVAVFASVPGIIFTKCQKEDSVYVCGPYFPRGWNNFHTIMRNILGLVLPLLIMVICYSGILKTLLRCRNEKKRHRAVRVIFTIMIVYFLFWTPYNIVILLNTFQEFFGLSNCESTSQLDQATQVTETLGMTHCCINPIIYAFVGEKFRSLFHIALGCRIAPLQKPVCGGPGVRPGKNVKVTTQGLLDGRGKGKSIGRAPEASLQDKEGA

SEQ ID NO: 1294 - protein, 360 aa, homo sapiens
MLSTSRSRFIRNTNESGEEVTTFFDYDYGAPCHKFDVKQIGAQLLPPLYSLVFIFGFVGNMLVVLILINCKKLKCLTDIYLLNLAISDLLFLITLPLWAHSAANEWVFGNAMCKLFTGLYHIGYFGGIFFIILLTIDRYLAIVHAVFALKARTVTFGVVTSVITWLVAVFASVPGIIFTKCQKEDSVYVCGPYFPRGWNNFHTIMRNILGLVLPLLIMVICYSGILKTLLRCRNEKKRHRAVRVIFTIMIVYFLFWTPYNIVILLNTFQEFFGLSNCESTSQLDQATQVTETLGMTHCCINPIIYAFVGEKFRRYLSVFFRKHITKRFCKQCPVFYRETVDGVTSTNTPSTGEQEVSAGL

SEQ ID NO: 1295 - protein, 361 aa, homo sapiens
MNESRWTEWRILNMSSGIVNVSERHSCPLGFGHYSVVDVCIFETVVIVLLTFLIIAGNLTVIFVFHCAPLLHHYTTSYFIQTMAYADLFVGVSCLVPTLSLLHYSTGVHESLTCQVFGYIISVLKSVSMACLACISVDRYLAITKPLSYNQLVTPCRLRICIILIWIYSCLIFLPSFFGWGKPGYHGDIFEWCATSWLTSAYFTGFIVCLLYAPAAFVVCFTYFHIFKICRQHTKEINDRRARFPSHEVDSSRETGHSPDRRYAMVLFRITSVFYMLWLPYIIYFLLESSRVLDNPTLSFLTTWLAISNSFCNCVIYSLSNSVFRLGLRRLSETMCTSCMCVKDQEAQEPKPRKRANSCSI

SEQ ID NO: 1296 - protein, 908 aa, homo sapiens
MVCEGKRSASCPCFFLLTAKFYWILTMMQRTHSQEYAHSIRVDGDIILGGLFPVHAKGERGVPCGELKKEKGIHRLEAMLYAIDQINKDPDLLSNITLGVRILDTCSRDTYALEQSLTFVQALIEKDASDVKCANGDPPIFTKPDKISGVIGAAASSVSIMVANILRLFKIPQISYASTAPELSDNTRYDFFSRVVPPDSYQAQAMVDIVTALGWNYVSTLASEGNYGESGVEAFTQISREIGGVCIAQSQKIPREPRPGEFEKIIKRLLETPNARAVIMFANEDDIRRILEAAKKLNQSGHFLWIGSDSWGSKIAPVYQQEEIAEGAVTILPKRASIDGFDRYFRSRTLANNRRNVWFAEFWEENFGCKLGSHGKRNSHIKKCTGLERIARDSSYEQEGKVQFVIDAVYSMAYALHNMHKDLCPGYIGLCPRMSTIDGKELLGYIRAVNFNGSAGTPVTFNENGDAPGRYDIFQYQITNKSTEYKVIGHWTNQLHLKVEDMQWAHREHTHPASVCSLPCKPGERKKTVKGVPCCWHCERCEGYNYQVDELSCELCPLDQRPNMNRTGCQLIPIIKLEWHSPWAVVPVFVAILGIIATTFVIVTFVRYNDTPIVRASGRELSYVLLTGIFLCYSITFLMIAAPDTIICSFRRVFLGLGMCFSYAALLTKTNRIHRIFEQGKKSVTAPKFISPASQLVITFSLISVQLLGVFVWFVVDPPHIIIDYGEQRTLDPEKARGVLKCDISDLSLICSLGYSILLMVTCTVYAIKTRGVPETFNEAKPIGFTMYTTCIIWLAFIPIFFGTAQSAEKMYIQTTTLTVSMSLSASVSLGMLYMPKVYIIIFHPEQNVQKRKRSFKAVVTAATMQSKLIQKGNDRPNGEVKSELCESLETNTSSTKTTYISYSNHSI

SEQ ID NO: 1297 - protein, 426 aa, homo sapiens
MTPLCLNCSVLPGDLYPGGARNPMACNGSAARGHFDPEDLNLTDEALRLKYLGPQQTELFMPICATYLLIFVVGAVGNGLTCLVILRHKAMRTPTNYYLFSLAVSDLLVLLVGLPLELYEMWHNYPFLLGVGGCYFRTLLFEMVCLASVLNVTALSVERYVAVVHPLQARSMVTRAHVRRVLGAVWGLAMLCSLPNTSLHGIRQLHVPCRGPVPDSAVCMLVRPRALYNMVVQTTALLFFCLPMAIMSVLYLLIGLRLRRERLLLMQEAKGRGSAAARSRYTCRLQQHDRGRRQVTKMLFVLVVVFGICWAPFHADRVMWSVVSQWTDGLHLAFQHVHVISGIFFYLGSAANPVLYSLMSSRFRETFQEALCLGACCHRLRPRHSSHSLSRMTTGSTLCDVGSLGSWVHPLAGNDGPEAQQETDPS

SEQ ID NO: 1298 - protein, 317 aa, homo sapiens
MAVQGSQRRLLGSLNSTPTAIPQLGLAANQTGARCLEVSISDGLFLSLGLVSLVENALVVATIAKNRNLHSPMYCFICCLALSDLLVSGSNVLETAVILLLEAGALVARAAVLQQLDNVIDVITCSSMLSSLCFLGAIAVDRYISIFYALRYHSIVTLPRARRAVAAIWVASVVFSTLFIAYYDHVAVLLCLVVFFLAMLVLMAVLYVHMLARACQHAQGIARLHKRQRPVHQGFGLKGAVTLTILLGIFFLCWGPFFLHLTLIVLCPEHPTCGCIFKNFNLFLALIICNAIIDPLIYAFHSQELRRTLKEVLTCSW

SEQ ID NO: 1299 - protein, 445 aa, homo sapiens
MERAPPDGPLNASGALAGEAAAAGGARGFSAAWTAVLAALMALLIVATVLGNALVMLAFVADSSLRTQNNFFLLNLAISDFLVGAFCIPLYVPYVLTGRWTFGRGLCKLWLVVDYLLCTSSAFNIVLISYDRFLSVTRAVSYRAQQGDTRRAVRKMLLVWVLAFLLYGPAILSWEYLSGGSSIPEGHCYAEFFYNWYFLITASTLEFFTPFLSVTFFNLSIYLNIQRRTRLRLDGAREAAGPEPPPEAQPSPPPPPGCWGCWQKGHGEAMPLHRYGVGEAAVGAEAGEATLGGGGGGGSVASPTSSSGSSSRGTERPRSLKRGSKPSASSASLEKRMKMVSQSFTQRFRLSRDRKVAKSLAVIVSIFGLCWAPYTLLMIIRAACHGHCVPDYWYETSFWLLWANSAVNPVLYPLCHHSFRRAFTKLLCPQKLKIQPHSSLEHCWK

SEQ ID NO: 1300 - protein, 1338 aa, homo sapiens
MGAGGRRMRGAPARLLLPLLPWLLLLLAPEARGAPGCPLSIRSCKCSGERPKGLSGGVPGPARRRVVCSGGDLPEPPEPGLLPNGTVTLLLSNNKITGLRNGSFLGLSLLEKLDLRNNIISTVQPGAFLGLGELKRLDLSNNRIGCLTSETFQGLPRLLRLNISGNIFSSLQPGVFDELPALKVVDLGTEFLTCDCHLRWLLPWAQNRSLQLSEHTLCAYPSALHAQALGSLQEAQLCCEGALELHTHHLIPSLRQVVFQGDRLPFQCSASYLGNDTRIRWYHNRAPVEGDEQAGILLAESLIHDCTFITSELTLSHIGVWASGEWECTVSMAQGNASKKVEIVVLETSASYCPAERVANNRGDFRWPRTLAGITAYQSCLQYPFTSVPLGGGAPGTRASRRCDRAGRWEPGDYSHCLYTNDITRVLYTFVLMPINASNALTLAHQLRVYTAEAASFSDMMDVVYVAQMIQKFLGYVDQIKELVEVMVDMASNLMLVDEHLLWLAQREDKACSRIVGALERIGGAALSPHAQHISVNARNVALEAYLIKPHSYVGLTCTAFQRREGGVPGTRPGSPGQNPPPEPEPPADQQLRFRCTTGRPNVSLSSFHIKNSVALASIQLPPSLFSSLPAALAPPVPPDCTLQLLVFRNGRLFHSHSNTSRPGAAGPGKRRGVATPVIFAGTSGCGVGNLTEPVAVSLRHWAEGAEPVAAWWSQEGPGEAGGWTSEGCQLRSSQPNVSALHCQHLGNVAVLMELSAFPREVGGAGAGLHPVVYPCTALLLLCLFATIITYILNHSSIRVSRKGWHMLLNLCFHIAMTSAVFAGGITLTNYQMVCQAVGITLHYSSLSTLLWMGVKARVLHKELTWRAPPPQEGDPALPTPSPMLRFYLIAGGIPLIICGITAAVNIHNYRDHSPYCWLVWRPSLGAFYIPVALILLITWIYFLCAGLRLRGPLAQNPKAGNSRASLEAGEELRGSTRLRGSGPLLSDSGSLLATGSARVGTPGPPEDGDSLYSPGVQLGALVTTHFLYLAMWACGALAVSQRWLPRVVCSCLYGVAASALGLFVFTHHCARRRDVRASWRACCPPASPAAPHAPPRALPAAAEDGSPVFGEGPPSLKSSPSGSSGHPLALGPCKLTNLQLAQSQVCEAGAAAGGEGEPEPAGTRGNLAHRHPNNVHHGRRAHKSRAKGHRAGEACGKNRLKALRGGAAGALELLSSESGSLHNSPTDSYLGSSRNSPGAGLQLEGEPMLTPSEGSDTSAAPLSEAGRAGQRRSASRDSLKGGGALEKESHRRSYPLNAASLNGAPKGGKYDDVTLMGAEVASGGCMKTGLWKSETTV

SEQ ID NO: 1301 - protein, 354 aa, homo sapiens
MTAAIRRQRELSILPKVTLEAMNTTVMQGFNRSERCPRDTRIVQLVFPALYTVVFLTGILLNTLALWVFVHIPSSSTFIIYLKNTLVADLIMTLMLPFKILSDSHLAPWQLRAFVCRFSSVIFYETMYVGIVLLGLIAFDRFLKIIRPLRNIFLKKPVFAKTVSIFIWFFLFFISLPNTILSNKEATPSSVKKCASLKGPLGLKWHQMVNNICQFIFWTVFILMLVFYVVIAKKVYDSYRKSKSKDRKNNKKLEGKVFVVVAVFFVCFAPFHFARVPYTHSQTNNKTDCRLQNQLFIAKETTLFLAATNICMDPLIYIFLCKKFTEKLPCMQGRKTTASSQENHSSQTDNITLG

SEQ ID NO: 1302 - protein, 465 aa, homo sapiens
MFRQEQPLAEGSFAPMGSLQPDAGNASWNGTEAPGGGARATPYSLQVTLTLVCLAGLLMLLTVFGNVLVIIAVFTSRALKAPQNLFLVSLASADILVATLVIPFSLANEVMGYWYFGKAWCEIYLALDVLFCTSSIVHLCAISLDRYWSITQAIEYNLKRTPRRIKAIIITVWVISAVISFPPLISIEKKGGGGGPQPAEPRCEINDQKWYVISSCIGSFFAPCLIMILVYVRIYQIAKRRTRVPPSRRGPDAVAAPPGGTERRPNGLGPERSAGPGGAEAEPLPTQLNGAPGEPAPAGPRDTDALDLEESSSSDHAERPPGPRRPERGPRGKGKARASQVKPGDSLPRRGPGATGIGTPAAGPGEERVGAAKASRWRGRQNREKRFTFVLAVVIGVFVVCWFPFFFTYTLTAVGCSVPRTLFKFFFWFGYCNSSLNPVIYTIFNHDFRRAFKKILCRGDRKRIV

SEQ ID NO: 1303 - protein, 481 aa, homo sapiens
MALSYRVSELQSTIPEHILQSTFVHVISSNWSGLQTESIPEEMKQIVEEQGNKLHWAALLILMVIIPTIGGNTLVILAVSLEKKLQYATNYFLMSLAVADLLVGLFVMPIALLTIMFEAMWPLPLVLCPAWLFLDVLFSTASIMHLCAISVDRYIAIKKPIQANQYNSRATAFIKITVVWLISIGIAIPVPIKGIETDVDNPNNITCVLTKERFGDFMLFGSLAAFFTPLAIMIVTYFLTIHALQKKAYLVKNKPPQRLTWLTVSTVFQRDETPCSSPEKVAMLDGSRKDKALPNSGDETLMRRTSTIGKKSVQTISNEQRASKVLGIVFFLFLLMWCPFFITNITLVLCDSCNQTTLQMLLEIFVWIGYVSSGVNPLVYTLFNKTFRDAFGRYITCNYRATKSVKTLRKRSSKIYFRNPMAENSKFFKKHGIRNGINPAMYQSPMRLRSSTIQSSSIILLDTLLLTENEGDKTEEQVSYV

SEQ ID NO: 1304 - protein, 425 aa, homo sapiens
MEPSATPGAQMGVPPGSREPSPVPPDYEDEFLRYLWRDYLYPKQYEWVLIAAYVAVFVVALVGNTLVCLAVWRNHHMRTVTNYFIVNLSLADVLVTAICLPASLLVDITESWLFGHALCKVIPYLQAVSVSVAVLTLSFIALDRWYAICHPLLFKSTARRARGSILGIWAVSLAIMVPQAAVMECSSVLPELANRTRLFSVCDERWADDLYPKIYHSCFFIVTYLAPLGLMAMAYFQIFRKLWGRQIPGTTSALVRNWKRPSDQLGDLEQGLSGEPQPRARAFLAEVKQMRARRKTAKMLMVVLLVFALCYLPISVLNVLKRVFGMFRQASDREAVYACFTFSHWLVYANSAANPIIYNFLSGKFREQFKAAFSCCLPGLGPCGSLKAPSPRSSASHKSLSLQSRCSISKISEHVVLTSVTTVLP

SEQ ID NO: 1305 - protein, 444 aa, homo sapiens
MSGTKLEDSPPCRNWSSASELNETQEPFLNPTDYDDEEFLRYLWREYLHPKEYEWVLIAGYIIVFVVALIGNVLVCVAVWKNHHMRTVTNYFIVNLSLADVLVTITCLPATLVVDITETWFFGQSLCKVIPYLQTVSVSVSVLTLSCIALDRWYAICHPLMFKSTAKRARNSIVIIWIVSCIIMIPQAIVMECSTVFPGLANKTTLFTVCDERWGGEIYPKMYHICFFLVTYMAPLCLMVLAYLQIFRKLWCRQIPGTSSVVQRKWKPLQPVSQPRGPGQPTKSRMSAVAAEIKQIRARRKTARMLMIVLLVFAICYLPISILNVLKRVFGMFAHTEDRETVYAWFTFSHWLVYANSAANPIIYNFLSGKFREEFKAAFSCCCLGVHHRQEDRLTRGRTSTESRKSLTTQISNFDNISKLSEQVVLTSISTLPAANGAGPLQNW

SEQ ID NO: 1306 - protein, 423 aa, homo sapiens
MVPHLLLLCLLPLVRATEPHEGRADEQSAEAALAVPNASHFFSWNNYTFSDWQNFVGRRRYGAESQNPTVKALLIVAYSFIIVFSLFGNVLVCHVIFKNQRMHSATSLFIVNLAVADIMITLLNTPFTLVRFVNSTWIFGKGMCHVSRFAQYCSLHVSALTLTAIAVDRHQVIMHPLKPRISITKGVIYIAVIWTMATFFSLPHAICQKLFTFKYSEDIVRSLCLPDFPEPADLFWKYLDLATFILLYILPLLIISVAYARVAKKLWLCNMIGDVTTEQYFALRRKKKKTIKMLMLVVVLFALCWFPLNCYVLLLSSKVIRTNNALYFAFHWFAMSSTCYNPFIYCWLNENFRIELKALLSMCQRPPKPQEDRPPSPVPSFRVAWTEKNDGQRAPLANNLLPTSQLQSGKTDLSSVEPIVTMS

SEQ ID NO: 1307 - protein, 337 aa, homo sapiens
MRAVFIQGAEEHPAAFCYQVNGSCPRTVHTLGIQLVIYLACAAGMLIIVLGNVFVAFAVSYFKALHTPTNFLLLSLALADMFLGLLVLPLSTIRSVESCWFFGDFLCRLHTYLDTLFCLTSIFHLCFISIDRHCAICDPLLYPSKFTVRVALRYILAGWGVPAAYTSLFLYTDVVETRLSQWLEEMPCVGSCQLLLNKFWGWLNFPLFFVPCLIMISLYVKIFVVATRQAQQITTLSKSLAGAAKHERKAAKTLGIAVGIYLLCWLPFTIDTMVDSLLHFITPPLVFDIFIWFAYFNSACNPIIYVFSYQWFRKALKLTLSQKVFSPQTRTVDLYQE

SEQ ID NO: 1308 - protein, 358 aa, homo sapiens
MGFNLTLAKLPNNELHGQESHNSGNRSDGPGKNTTLHNEFDTIVLPVLYLIIFVASILLNGLAVWIFFHIRNKTSFIFYLKNIVVADLIMTLTFPFRIVHDAGFGPWYFKFILCRYTSVLFYANMYTSIVFLGLISIDRYLKVVKPFGDSRMYSITFTKVLSVCVWVIMAVLSLPNIILTNGQPTEDNIHDCSKLKSPLGVKWHTAVTYVNSCLFVAVLVILIGCYIAISRYIHKSSRQFISQSSRKRKHNQSIRVVVAVFFTCFLPYHLCRIPFTFSHLDRLLDESAQKILYYCKEITLFLSACNVCLDPIIYFFMCRSFSRRLFKKSNIRTRSESIRSLQSVRRSEVRIYYDYTDV

SEQ ID NO: 1309 - protein, 549 aa, homo sapiens
MATPRGLGALLLLLLLPTSGQEKPTEGPRNTCLGSNNMYDIFNLNDKALCFTKCRQSGSDSCNVENLQRYWLNYEAHLMKEGLTQKVNTPFLKALVQNLSTNTAEDFYFSLEPSQVPRQVMKDEDKPPDRVRLPKSLFRSLPGNRSVVRLAVTILDIGPGTLFKGPRLGLGDGSGVLNNRLVGLSVGQMHVTKLAEPLEIVFSHQRPPPNMTLTCVFWDVTKGTTGDWSSEGCSTEVRPEGTVCCCDHLTFFALLLRPTLDQSTVHILTRISQAGCGVSMIFLAFTIILYAFLRLSRERFKSEDAPKIHVALGGSLFLLNLAFLVNVGSGSKGSDAACWARGAVFHYFLLCAFTWMGLEAFHLYLLAVRVFNTYFGHYFLKLSLVGWGLPALMVIGTGSANSYGLYTIRDRENRTSLELCWFREGTTMYALYITVHGYFLITFLFGMVVLALVVWKIFTLSRATAVKERGKNRKKVLTLLGLSSLVGVTWGLAIFTPLGLSTVYIFALFNSLQGVFICCWFTILYLPSQSTTVSSSTARLDQAHSASQE

SEQ ID NO: 1310 - protein, 797 aa, homo sapiens
MASCRAWNLRVLVAVVCGLLTGIILGLGIWRIVIRIQRGKSTSSSSTPTEFCRNGGTWENGRCICTEEWKGLRCTIANFCENSTYMGFTFARIPVGRYGPSLQTCGKDTPNAGNPMAVRLCSLSLYGEIELQKVTIGNCNENLETLEKQVKDVTAPLNNISSEVQILTSDANKLTAENITSATRVVGQIFNTSRNASPEAKKVAIVTVSQLLDASEDAFQRVAATANDDALTTLIEQMETYSLSLGNQSVVEPNIAIQSANFSSENAVGPSNVRFSVQKGASSSLVSSSTFIHTNVDGLNPDAQTELQVLLNMTKNYTKTCGFVVYQNDKLFQSKTFTAKSDFSQKIISSKTDENEQDQSASVDMVFSPKYNQKEFQLYSYACVYWNLSAKDWDTYGCQKDKGTDGFLRCRCNHTTNFAVLMTFKKDYQYPKSLDILSNVGCALSVTGLALTVIFQIVTRKVRKTSVTWVLVNLCISMLIFNLLFVFGIENSNKNLQTSDGDINNIDFDNNDIPRTDTINIPNPMCTAIAALLHYFLLVTFTWNALSAAQLYYLLIRTMKPLPRHFILFISLIGWGVPAIVVAITVGVIYSQNGNNPQWELDYRQEKICWLAIPEPNGVIKSPLLWSFIVPVTIILISNVVMFITISIKVLWKNNQNLTSTKKVSSMKKIVSTLSVAVVFGITWILAYLMLVNDDSIRIVFSYIFCLFNTTQGLQIFILYTVRTKVFQSEASKVLMLLSSIGRRKSLPSVTRPRLRVKMYNFLRSLPTLHERFRLLETSPSTEEITLSESDNAKESI

SEQ ID NO: 1311 - protein, 322 aa, homo sapiens
MDPTVPVFGTKLTPINGREETPCYNQTLSFTVLTCIISLVGLTGNAVVLWLLGYRMRRNAVSIYILNLAAADFLFLSFQIIRLPLRLINISHLIRKILVSVMTFPYFTGLSMLSAISTERCLSVLWPIWYRCRRPTHLSAVVCVLLWGLSLLFSMLEWRFCDFLFSGADSSWCETSDFIPVAWLIFLCVVLCVSSLVLLVRILCGSRKMPLTRLYVTILLTVLVFLLCGLPFGILGALIYRMHLNLEVLYCHVYLVCMSLSSLNSSANPIIYFFVGSFRQRQNRQNLKLVLQRALQDKPEVDKGEGQLPEESLELSGSRLGP

SEQ ID NO: 1312 - protein, 289 aa, homo sapiens
MFGLFGLWRTFDSVVFYLTLIVGLGGPVGNGLVLWNLGFRIKKGPFSIYLLHLAAADFLFLSCRVGFSVAQAALGAQDTLYFVLTFLWFAVGLWLLAAFSVERCLSDLFPACYQGCRPRHASAVLCALVWTPTLPAVPLPANACGLLRNSACPLVCPRYHVASVTWFLVLARVAWTAGVVLFVWVTCCSTRPRPRLYGIVLGALLLLFFCGLPSVFYWSLQPLLNFLLPVFSPLATLLACVNSSSKPLIYSGLGRQPGKREPLRSVLRRALGEGAELGARGQSLPMGLL

SEQ ID NO: 1313 - protein, 322 aa, homo sapiens
MDSTIPVLGTELTPINGREETPCYKQTLSFTGLTCIVSLVALTGNAVVLWLLGCRMRRNAVSIYILNLVAADFLFLSGHIICSPLRLINIRHPISKILSPVMTFPYFIGLSMLSAISTERCLSILWPIWYHCRRPRYLSSVMCVLLWALSLLRSILEWMFCDFLFSGANSVWCETSDFITIAWLVFLCVVLCGSSLVLLVRILCGSRKMPLTRLYVTILLTVLVFLLCGLPFGIQWALFSRIHLDWKVLFCHVHLVSIFLSALNSSANPIIYFFVGSFRQRQNRQNLKLVLQRALQDTPEVDEGGGWLPQETLELSGSRLEQ

SEQ ID NO: 1314 - protein, 814 aa, homo sapiens
MEPEINCSELCDSFPGQELDRRPLHDLCKTTITSSHHSSKTISSLSPVLLGIVWTFLSCGLLLILFFLAFTIHCRKNRIVKMSSPNLNIVTLLGSCLTYSSAYLFGIQDVLVGSSMETLIQTRLSMLCIGTSLVFGPILGKSWRLYKVFTQRVPDKRVIIKDLQLLGLVAALLMADVILLMTWVLTDPIQCLQILSVSMTVTGKDVSCTSTSTHFCASRYSDVWIALIWGCKGLLLLYGAYLAGLTGHVSSPPVNQSLTIMVGVNLLVLAAGLLFVVTRYLHSWPNLVFGLTSGGIFVCTTTINCFIFIPQLKQWKAFEEENQTIRRMAKYFSTPNKSFHTQYGEEENCHPRGEKSSMERLLTEKNAVIESLQEQVNNAKEKIVRLMSAECTYDLPEGAAPPASSPNKDVQAVASVHTLAAAQGPSGHLSDFQNDPGMAARDSQCTSGPSSYAQSLEGPGKDSSFSPGKEEKISDSKDFSDHLDSGCSQKPWTEQSLGPERGDQVPMNPSQSLLPERGGSDPQRQRHLENSEEPPERRSRVSSVIREKLQEVLQDLGLGPEASLSTAPSCHQQTWKNSAAFSPQKMPLSKELGFSPYMVRRRRAAQRARSHFPGSAPSSVGHRANRTVPGAHSRLHVQNGDSPSLAPQTTDSRVRRPSSRKPSLPSDPQDRPGTLEGSKQSQTEPEGARGSKAAFLRQPSGSGRAPSPAAPCLSKASPDLPEQWQLWPPVPSGCASLSSQHSYFDTESSSSDEFFCRCHRPYCEICFQSSSDSSDSGTSDTDPEPTGGLASWEKLWARSKPIVNFKDDLKPTLV

SEQ ID NO: 1315 - protein, 404 aa, homo sapiens
MASPRLGTFCCPTRDAATQLVLSFQPRAFHALCLGSGGLRLALGLLQLLPGRRPAGPGSPATSPPASVRILRAAAACDLLGCLGMVIRSTVWLGFPNFVDSVSDMNHTEIWPAAFCVGSAMWIQLLYSACFWWLFCYAVDAYLVIRRSAGLSTILLYHIMAWGLATLLCVEGAAMLYYPSVSRCERGLDHAIPHYVTMYLPLLLVLVANPILFQKTVTAVASLLKGRQGIYTENERRMGAVIKIRFFKIMLVLIICWLSNIINESLLFYLEMQTDINGGSLKPVRTAAKTTWFIMGILNPAQGFLLSLAFYGWTGCSLGFQSPRKEIQWESLTTSAAEGAHPSPLMPHENPASGKVSQVGGQTSDEALSMLSEGSDASTIEIHTASESCNKNEGDPALPTHGDL

SEQ ID NO: 1316 - protein, 609 aa, homo sapiens
MSDERRLPGSAVGWLVCGGLSLLANAWGILSVGAKQKKWKPLEFLLCTLAATHMLNVAVPIATYSVVQLRRQRPDFEWNEGLCKVFVSTFYTLTLATCFSVTSLSYHRMWMVCWPVNYRLSNAKKQAVHTVMGIWMVSFILSALPAVGWHDTSERFYTHGCRFIVAEIGLGFGVCFLLLVGGSVAMGVICTAIALFQTLAVQVGRQADRRAFTVPTIVVEDAQGKRRSSIDGSEPAKTSLQTTGLVTTIVFIYDCLMGFPVLVVSFSSLRADASAPWMALCVLWCSVAQALLLPVFLWACDRYRADLKAVREKCMALMANDEESDDETSLEGGISPDLVLERSLDYGYGGDFVALDRMAKYEISALEGGLPQLYPLRPLQEDKMQYLQVPPTRRFSHDDADVWAAVPLPAFLPRWGSGEDLAALAHLVLPAGPERRRASLLAFAEDAPPSRARRRSAESLLSLRPSALDSGPRGARDSPPGSPRRRPGPGPRSASASLLPDAFALTAFECEPQALRRPPGPFPAAPAAPDGADPGEAPTPPSSAQRSPGPRPSAHSHAGSLRPGLSASWGEPGGLRAAGGGGSTSSFLSSPSESSGYATLHSDSLGSAS

SEQ ID NO: 1317 - protein, 346 aa, homo sapiens
MGDELAPCPVGTTAWPALIQLISKTPCMPQAASNTSLGLGDLRVPSSMLYWLFLPSSLLAAATLAVSPLLLVTILRNQRLRQEPHYLLPANILLSDLAYILLHMLISSSSLGGWELGRMACGILTDAVFAACTSTILSFTAIVLHTYLAVIHPLRYLSFMSHGAAWKAVALIWLVACCFPTFLIWLSKWQDAQLEEQGASYILPPSMGTQPGCGLLVIVTYTSILCVLFLCTALIANCFWRIYAEAKTSGIWGQGYSRARGTLLIHSVLITLYVSTGVVFSLDMVLTRYHHIDSGTHTWLLAANSEVLMMLPRAMLTYLYLLRYRQLLGMVRGHLPSRRQAIFTIS

SEQ ID NO: 1318 - protein, 358 aa, homo sapiens
MSVCYRPPGNETLLSWKTSRATGTAFLLLAALLGLPGNGFVVWSLAGWRPARGRPLAATLVLHLALADGAVLLLTPLFVAFLTRQAWPLGQAGCKAVYYVCALSMYASVLLTGLLSLQRCLAVTRPFLAPRLRSPALARRLLLAVWLAALLLAVPAAVYRHLWRDRVCQLCHPSPVHAAAHLSLETLTAFVLPFGLMLGCYSVTLARLRGARWGSGRHGARVGRLVSAIVLAFGLLWAPYHAVNLLQAVAALAPPEGALAKLGGAGQAARAGTTALAFFSSSVNPVLYVFTAGDLLPRAGPRFLTRLFEGSGEARGGGRSREGTMELRTTPQLKVVGQGRGNGDPGGGMEKDGPEWDL

SEQ ID NO: 1319 - protein, 647 aa, homo sapiens
MAEEEAPKKSRAAGGGASWELCAGALSARLAEEGSGDAGGRRRPPVDPRRLARQLLLLLWLLEAPLLLGVRAQAAGQGPGQGPGPGQQPPPPPQQQQSGQQYNGERGISVPDHGYCQPISIPLCTDIAYNQTIMPNLLGHTNQEDAGLEVHQFYPLVKVQCSAELKFFLCSMYAPVCTVLEQALPPCRSLCERARQGCEALMNKFGFQWPDTLKCEKFPVHGAGELCVGQNTSDKGTPTPSLLPEFWTSNPQHGGGGHRGGFPGGAGASERGKFSCPRALKVPSYLNYHFLGEKDCGAPCEPTKVYGLMYFGPEELRFSRTWIGIWSVLCCASTLFTVLTYLVDMRRFSYPERPIIFLSGCYTAVAVAYIAGFLLEDRVVCNDKFAEDGARTVAQGTKKEGCTILFMMLYFFSMASSIWWVILSLTWFLAAGMKWGHEAIEANSQYFHLAAWAVPAIKTITILALGQVDGDVLSGVCFVGLNNVDALRGFVLAPLFVYLFIGTSFLLAGFVSLFRIRTIMKHDGTKTEKLEKLMVRIGVFSVLYTVPATIVIACYFYEQAFRDQWERSWVAQSCKSYAIPCPHLQAGGGAPPHPPMSPDFTVFMIKYLMTLIVGITSGFWIWSGKTLNSWRKFYTRLTNSKQGETTV

SEQ ID NO: 1320 - protein, 565 aa, homo sapiens
MRPRSALPRLLLPLLLLPAAGPAQFHGEKGISIPDHGFCQPISIPLCTDIAYNQTIMPNLLGHTNQEDAGLEVHQFYPLVKVQCSPELRFFLCSMYAPVCTVLEQAIPPCRSICERARQGCEALMNKFGFQWPERLRCEHFPRHGAEQICVGQNHSEDGAPALLTTAPPPGLQPGAGGTPGGPGGGGAPPRYATLEHPFHCPRVLKVPSYLSYKFLGERDCAAPCEPARPDGSMFFSQEETRFARLWILTWSVLCCASTFFTVTTYLVDMQRFRYPERPIIFLSGCYTMVSVAYIAGFVLQERVVCNERFSEDGYRTVVQGTKKEGCTILFMMLYFFSMASSIWWVILSLTWFLAAGMKWGHEAIEANSQYFHLAAWAVPAVKTITILAMGQIDGDLLSGVCFVGLNSLDPLRGFVLAPLFVYLFIGTSFLLAGFVSLFRIRTIMKHDGTKTEKLERLMVRIGVFSVLYTVPATIVIACYFYEQAFREHWERSWVSQHCKSLAIPCPAHYTPRMSPDFTVYMIKYLMTLIVGITSGFWIWSGKTLHSWRKFYTRLTNSRHGETTV

SEQ ID NO: 1321 - protein, 574 aa, homo sapiens
MRDPGAAAPLSSLGLCALVLALLGALSAGAGAQPYHGEKGISVPDHGFCQPISIPLCTDIAYNQTILPNLLGHTNQEDAGLEVHQFYPLVKVQCSPELRFFLCSMYAPVCTVLDQAIPPCRSLCERARQGCEALMNKFGFQWPERLRCENFPVHGAGEICVGQNTSDGSGGPGGGPTAYPTAPYLPDLPFTALPPGASDGRGRPAFPFSCPRQLKVPPYLGYRFLGERDCGAPCEPGRANGLMYFKEEERRFARLWVGVWSVLCCASTLFTVLTYLVDMRRFSYPERPIIFLSGCYFMVAVAHVAGFLLEDRAVCVERFSDDGYRTVAQGTKKEGCTILFMVLYFFGMASSIWWVILSLTWFLAAGMKWGHEAIEANSQYFHLAAWAVPAVKTITILAMGQVDGDLLSGVCYVGLSSVDALRGFVLAPLFVYLFIGTSFLLAGFVSLFRIRTIMKHDGTKTEKLEKLMVRIGVFSVLYTVPATIVLACYFYEQAFREHWERTWLLQTCKSYAVPCPPGHFPPMSPDFTVFMIKYLMTMIVGITTGFWIWSGKTLQSWRRFYHRLSHSSKGETAV

SEQ ID NO: 1322 - protein, 591 aa, homo sapiens
MAVAPLRGALLLWQLLAAGGAALEIGRFDPERGRGAAPCQAVEIPMCRGIGYNLTRMPNLLGHTSQGEAAAELAEFAPLVQYGCHSHLRFFLCSLYAPMCTDQVSTPIPACRPMCEQARLRCAPIMEQFNFGWPDSLDCARLPTRNDPHALCMEAPENATAGPAEPHKGLGMLPVAPRPARPPGDLGPGAGGSGTCENPEKFQYVEKSRSCAPRCGPGVEVFWSRRDKDFALVWMAVWSALCFFSTAFTVLTFLLEPHRFQYPERPIIFLSMCYNVYSLAFLIRAVAGAQSVACDQEAGALYVIQEGLENTGCTLVFLLLYYFGMASSLWWVVLTLTWFLAAGKKWGHEAIEAHGSYFHMAAWGLPALKTIVILTLRKVAGDELTGLCYVASTDAAALTGFVLVPLSGYLVLGSSFLLTGFVALFHIRKIMKTGGTNTEKLEKLMVKIGVFSILYTVPATCVIVCYVYERLNMDFWRLRATEQPCAAAAGPGGRRDCSLPGGSVPTVAVFMLKIFMSLVVGITSGVWVWSSKTFQTWQSLCYRKIAAGRARAKACRAPGSYGRGTHCHYKAPTVVLHMTKTDPSLENPTHL

SEQ ID NO: 1323 - protein, 787 aa, homo sapiens
MAAARPARGPELPLLGLLLLLLLGDPGRGAASSGNATGPGPRSAGGSARRSAAVTGPPPPLSHCGRAAPCEPLRYNVCLGSVLPYGATSTLLAGDSDSQEEAHGKLVLWSGLRNAPRCWAVIQPLLCAVYMPKCENDRVELPSRTLCQATRGPCAIVERERGWPDFLRCTPDRFPEGCTNEVQNIKFNSSGQCEVPLVRTDNPKSWYEDVEGCGIQCQNPLFTEAEHQDMHSYIAAFGAVTGLCTLFTLATFVADWRNSNRYPAVILFYVNACFFVGSIGWLAQFMDGARREIVCRADGTMRLGEPTSNETLSCVIIFVIVYYALMAGVVWFVVLTYAWHTSFKALGTTYQPLSGKTSYFHLLTWSLPFVLTVAILAVAQVDGDSVSGICFVGYKNYRYRAGFVLAPIGLVLIVGGYFLIRGVMTLFSIKSNHPGLLSEKAASKINETMLRLGIFGFLAFGFVLITFSCHFYDFFNQAEWERSFRDYVLCQANVTIGLPTKQPIPDCEIKNRPSLLVEKINLFAMFGTGIAMSTWVWTKATLLIWRRTWCRLTGQSDDEPKRIKKSKMIAKAFSKRHELLQNPGQELSFSMHTVSHDGPVAGLAFDLNEPSADVSSAWAQHVTKMVARRGAILPQDISVTPVATPVPPEEQANLWLVEAEISPELQKRLGRKKKRRKRKKEVCPLAPPPELHPPAPAPSTIPRLPQLPRQKCLVAAGAWGAGDSCRQGAWTLVSNPFCPEPSPPQDPFLPSAPAPVAWAHGRRQGLGPIHSRTNLMDTELMDADSDF

SEQ ID NO: 1324 - protein, 581 aa, homo sapiens
MQRPGPRLWLVLQVMGSCAAISSMDMERPGDGKCQPIEIPMCKDIGYNMTRMPNLMGHENQREAAIQLHEFAPLVEYGCHGHLRFFLCSLYAPMCTEQVSTPIPACRVMCEQARLKCSPIMEQFNFKWPDSLDCRKLPNKNDPNYLCMEAPNNGSDEPTRGSGLFPPLFRPQRPHSAQEHPLKDGGPGRGGCDNPGKFHHVEKSASCAPLCTPGVDVYWSREDKRFAVVWLAIWAVLCFFSSAFTVLTFLIDPARFRYPERPIIFLSMCYCVYSVGYLIRLFAGAESIACDRDSGQLYVIQEGLESTGCTLVFLVLYYFGMASSLWWVVLTLTWFLAAGKKWGHEAIEANSSYFHLAAWAIPAVKTILILVMRRVAGDELTGVCYVGSMDVNALTGFVLIPLACYLVIGTSFILSGFVALFHIRRVMKTGGENTDKLEKLMVRIGLFSVLYTVPATCVIACYFYERLNMDYWKILAAQHKCKMNNQTKTLDCLMAASIPAVEIFMVKIFMLLVVGITSGMWIWTSKTLQSWQQVCSRRLKKKSRRKPASVITSGGIYKKAQHPQKTHHGKYEIPAQSPTCV

SEQ ID NO: 1325 - protein, 666 aa, homo sapiens
MAMTWIVFSLWPLTVFMGHIGGHSLFSCEPITLRMCQDLPYNTTFMPNLLNHYDQQTAALAMEPFHPMVNLDCSRDFRPFLCALYAPICMEYGRVTLPCRRLCQRAYSECSKLMEMFGVPWPEDMECSRFPDCDEPYPRLVDLNLAGEPTEGAPVAVQRDYGFWCPRELKIDPDLGYSFLHVRDCSPPCPNMYFRREELSFARYFIGLISIICLSATLFTFLTFLIDVTRFRYPERPIIFYAVCYMMVSLIFFIGFLLEDRVACNASIPAQYKASTVTQGSHNKACTMLFMILYFFTMAGSVWWVILTITWFLAAVPKWGSEAIEKKALLFHASAWGIPGTLTIILLAMNKIEGDNISGVCFVGLYDVDALRYFVLAPLCLYVVVGVSLLLAGIISLNRVRIEIPLEKENQDKLVKFMIRIGVFSILYLVPLLVVIGCYFYEQAYRGIWETTWIQERCREYHIPCPYQVTQMSRPDLILFLMKYLMALIVGIPSVFWVGSKKTCFEWASFFHGRRKKEIVNESRQVLQEPDFAQSLLRDPNTPIIRKSRGTSTQGTSTHASSTQLAMVDDQRSKAGSIHSKVSSYHGSLHRSRDGRYTPCSYRGMEERLPHGSMSRLTDHSRHSSSHRLNEQSRHSSIRDLSNNPMTHITHGTSMNRVIEEDGTSA

SEQ ID NO: 1326 - protein, 694 aa, homo sapiens
MEWGYLLEVTSLLAALALLQRSSGAAAASAKELACQEITVPLCKGIGYNYTYMPNQFNHDTQDEAGLEVHQFWPLVEIQCSPDLKFFLCSMYTPICLEDYKKPLPPCRSVCERAKAGCAPLMRQYGFAWPDRMRCDRLPEQGNPDTLCMDYNRTDLTTAAPSPPRRLPPPPPGEQPPSGSGHGRPPGARPPHRGGGRGGGGGDAAAPPARGGGGGGKARPPGGGAAPCEPGCQCRAPMVSVSSERHPLYNRVKTGQIANCALPCHNPFFSQDERAFTVFWIGLWSVLCFVSTFATVSTFLIDMERFKYPERPIIFLSACYLFVSVGYLVRLVAGHEKVACSGGAPGAGGAGGAGGAAAGAGAAGAGAGGPGGRGEYEELGAVEQHVRYETTGPALCTVVFLLVYFFGMASSIWWVILSLTWFLAAGMKWGNEAIAGYSQYFHLAAWLVPSVKSIAVLALSSVDGDPVAGICYVGNQSLDNLRGFVLAPLVIYLFIGTMFLLAGFVSLFRIRSVIKQQDGPTKTHKLEKLMIRLGLFTVLYTVPAAVVVACLFYEQHNRPRWEATHNCPCLRDLQPDQARRPDYAVFMLKYFMCLVVGITSGVWVWSGKTLESWRSLCTRCCWASKGAAVGGGAGATAAGGGGGPGGGGGGGPGGGGGPGGGGGSLYSDVSTGLTWRSGTASSVSYPKQMPLSQV

SEQ ID NO: 1327 - protein, 537 aa, homo sapiens
MAWRGAGPSVPGAPGGVGLSLGLLLQLLLLLGPARGFGDEEERRCDPIRISMCQNLGYNVTKMPNLVGHELQTDAELQLTTFTPLIQYGCSSQLQFFLCSVYVPMCTEKINIPIGPCGGMCLSVKRRCEPVLKEFGFAWPESLNCSKFPPQNDHNHMCMEGPGDEEVPLPHKTPIQPGEECHSVGTNSDQYIWVKRSLNCVLKCGYDAGLYSRSAKEFTDIWMAVWASLCFISTAFTVLTFLIDSSRFSYPERPIIFLSMCYNIYSIAYIVRLTVGRERISCDFEEAAEPVLIQEGLKNTGCAIIFLLMYFFGMASSIWWVILTLTWFLAAGLKWGHEAIEMHSSYFHIAAWAIPAVKTIVILIMRLVDADELTGLCYVGNQNLDALTGFVVAPLFTYLVIGTLFIAAGLVALFKIRSNLQKDGTKTDKLERLMVKIGVFSVLYTVPATCVIACYFYEISNWALFRYSADDSNMAVEMLKIFMSLLVGITSGMWIWSAKTLHTWQKCSNRLVNSGKVKREKRGNGWVKPGKGSETVV

SEQ ID NO: 1328 - protein, 585 aa, homo sapiens
MARPDPSAPPSLLLLLLAQLVGRAAAASKAPVCQEITVPMCRGIGYNLTHMPNQFNHDTQDEAGLEVHQFWPLVEIQCSPDLRFFLCSMYTPICLPDYHKPLPPCRSVCERAKAGCSPLMRQYGFAWPERMSCDRLPVLGRDAEVLCMDYNRSEATTAPPRPFPAKPTLPGPPGAPASGGECPAGGPFVCKCREPFVPILKESHPLYNKVRTGQVPNCAVPCYQPSFSADERTFATFWIGLWSVLCFISTSTTVATFLIDMERFRYPERPIIFLSACYLCVSLGFLVRLVVGHASVACSREHNHIHYETTGPALCTIVFLLVYFFGMASSIWWVILSLTWFLAAGMKWGNEAIAGYAQYFHLAAWLIPSVKSITALALSSVDGDPVAGICYVGNQNLNSLRGFVLGPLVLYLLVGTLFLLAGFVSLFRIRSVIKQGGTKTDKLEKLMIRIGIFTLLYTVPASIVVACYLYEQHYRESWEAALTCACPGHDTGQPRAKPEYWVLMLKYFMCLVVGITSGVWIWSGKTVESWRRFTSRCCCRPRRGHKSGGAMAAGDYPEASAALTGRTGPPGPAATYHKQVSLSHV

SEQ ID NO: 1329 - protein, 706 aa, homo sapiens
MEMFTFLLTCIFLPLLRGHSLFTCEPITVPRCMKMAYNMTFFPNLMGHYDQSIAAVEMEHFLPLANLECSPNIETFLCKAFVPTCIEQIHVVPPCRKLCEKVYSDCKKLIDTFGIRWPEELECDRLQYCDETVPVTFDPHTEFLGPQKKTEQVQRDIGFWCPRHLKTSGGQGYKFLGIDQCAPPCPNMYFKSDELEFAKSFIGTVSIFCLCATLFTFLTFLIDVRRFRYPERPIIYYSVCYSIVSLMYFIGFLLGDSTACNKADEKLELGDTVVLGSQNKACTVLFMLLYFFTMAGTVWWVILTITWFLAAGRKWSCEAIEQKAVWFHAVAWGTPGFLTVMLLAMNKVEGDNISGVCFVGLYDLDASRYFVLLPLCLCVFVGLSLLLAGIISLNHVRQVIQHDGRNQEKLKKFMIRIGVFSGLYLVPLVTLLGCYVYEQVNRITWEITWVSDHCRQYHIPCPYQAKAKARPELALFMIKYLMTLIVGISAVFWVGSKKTCTEWAGFFKRNRKRDPISESRRVLQESCEFFLKHNSKVKHKKKHYKPSSHKLKVISKSMGTSTGATANHGTSAVAITSHDYLGQETLTEIQTSPETSMREVKADGASTPRLREQDCGEPASPAASISRLSGEQVDGKGQAGSVSESARSEGRISPKSDITDTGLAQSNNLQVPSSSEPSSLKGSTSLLVHPVSGVRKEQGGGCHSDT

SEQ ID NO: 1330 - protein, 37 aa, Artificial Sequence; identical to SEQ ID NO: 530
  GLP-1 (7-36)

SEQ ID NO: 1331 - protein, 37 aa, Artificial Sequence; identical to SEQ ID NO: 530
  GLP-1 (7-37)

SEQ ID NO: 1332 - protein, 39 aa, Artificial Sequence; identical to SEQ ID NO: 717
  Exendin 4

SEQ ID NO: 1333 - protein, 43 aa, Artificial Sequence
  DP-178
YTSLHHSLIEESQNQQEKNEQELLELDKWASLSGAPPPSWNWF

SEQ ID NO: 1334 - protein, 44 aa, Artificial Sequence
  DP-178
EWDREINNYTSLIHSLIEESQNQQEKNEQELLELDKWASLWNWF

SEQ ID NO: 1335 - protein, 29 aa, homo sapiens
HSDGTFTSDYSKYLDSRRAQDFVQWLMNT

SEQ ID NO: 1336 - protein, 39 aa, homo sapiens
DNPSLSIDLTFHLLRTLLELADTQSQRERAQNRIIFDSV

SEQ ID NO: 1337 - protein, 148 aa, homo sapiens
MARIPTAALGCISLLCLQLPGSLSRSLGGDPRPVKPREPPARSPSSSLQPRHPAPRPVVWKLHRALQAQRGAGLAPVMGQPLRDGGRQHSGPRRHSGPRRTQAQLLRVGCVLGTCQVQNLSHRLWQLMGPAGRQDSAPVDPSSPHSYG

SEQ ID NO: 1338 - protein, 51 aa, homo sapiens
YRQSMNNFQGLRFGCRFGTCTVQKLAHQIYQFTDKDKDNVAPRNKISPQGY

SEQ ID NO: 1339 - protein, 17 aa, homo sapiens
DRMPCKNFFWKTFSSCK

SEQ ID NO: 1340 - protein, 10 aa, homo sapiens
HSDAVFTDNY

SEQ ID NO: 1341 - protein, 9 aa, homo sapiens
HSDAVFTDN

SEQ ID NO: 1342 - protein, 28 aa, Artificial Sequence
  VIP analog
HSDAVFTDNYTRLRKQLAVKKYLNAILN

SEQ ID NO: 1343 - protein, 28 aa, Artificial Sequence
  VIP analog
  MISC_FEATURE (14)..(14): Xaa = Ala Pro Cys
  MISC_FEATURE (18)..(19): Xaa = Ala Cys Pro Cys
  MISC_FEATURE (25)..(25): Xaa = Ala Cys Pro Cys
HSDAVFTDNYTRLXKQLXVKKYLNXILN

SEQ ID NO: 1344 - protein, 28 aa, Artificial Sequence
  VIP analog
  MISC_FEATURE (14)..(14): Xaa = Ala Pro Cys
  MISC_FEATURE (18)..(18): Xaa = Ala Cys Pro Cys
  MISC_FEATURE (21)..(21): Xaa = Ala Pro Cys
  MISC_FEATURE (25)..(25): Xaa = Ala Cys Pro Cys
HSDAVFTDNYTRLXKQLXVKXYLNXILN

SEQ ID NO: 1345 - protein, 28 aa, Artificial Sequence
  VIP analog
  MISC_FEATURE (11)..(11): Xaa = Ala Cys Pro Cys
  MISC_FEATURE (14)..(14): Xaa = Ala Pro Cys
  MISC_FEATURE (18)..(18): Xaa = Ala Cys Pro Cys
  MISC_FEATURE (25)..(25): Xaa = Ala Cys Pro Cys
HSDAVFTDNYXRLXKQLXVKKYLNXILN

SEQ ID NO: 1346 - protein, 28 aa, Artificial Sequence
  VIP analog
  MISC_FEATURE (11)..(11): Xaa = Ala Cys Pro Cys
  MISC_FEATURE (14)..(14): Xaa = Ala Pro Cys
  MISC_FEATURE (18)..(18): Xaa = Ala Cys Pro Cys
  MISC_FEATURE (21)..(21): Xaa = Ala Pro Cys
  MISC_FEATURE (25)..(25): Xaa = Ala Cys Pro Cys
HSDAVFTDNYXRLXKQLXVKXYLNXILN

SEQ ID NO: 1347 - protein, 28 aa, Artificial Sequence
  VIP analog
  MISC_FEATURE (15)..(15): Xaa = Ala Pro Cys
  MISC_FEATURE (18)..(18): Xaa = Ala Cys Pro Cys
  MISC_FEATURE (25)..(25): Xaa = Ala Cys Pro Cys
HSDAVFTDNYTRLRXQLXVKKYLNXILN

SEQ ID NO: 1348 - protein, 28 aa, Artificial Sequence
  VIP analog
  misc_feature (11)..(11): Xaa can be any naturally occurring amino acid
  misc_feature (15)..(15): Xaa can be any naturally occurring amino acid
  misc_feature (18)..(18): Xaa can be any naturally occurring amino acid
  misc_feature (25)..(25): Xaa can be any naturally occurring amino acid
HSDAVFTDNYXRLRXQLXVKKYLNXILN

SEQ ID NO: 1349 - protein, 28 aa, Artificial Sequence
  VIP analog
  MISC_FEATURE (14)..(14): Xaa = Ala Pro Cys
  MISC_FEATURE (21)..(21): Xaa = Ala Pro Cys
  MISC_FEATURE (24)..(24): Xaa = Ala Cys Pro Cys
HSDAVFTDNYTRLXKQLAVKXYLXAILN

SEQ ID NO: 1350 - protein, 28 aa, Artificial Sequence
  VIP Analog
  MISC_FEATURE (14)..(14): Xaa = Ala Pro Cys
  MISC_FEATURE (17)..(17): Xaa = Ala Cys Pro Cys
  MISC_FEATURE (24)..(24): Xaa = Ala Cys Pro Cys
HSDAVFTDNYTRLXKQXAVKKYLXAILN

SEQ ID NO: 1351 - protein, 28 aa, Artificial Sequence
  VIP analog
  MISC_FEATURE (14)..(14): Xaa = Ala Pro Cys
  MISC_FEATURE (17)..(17): Xaa = Ala Cys Pro Cys
  MISC_FEATURE (21)..(21): Xaa = Ala Pro Cys
  MISC_FEATURE (24)..(24): Xaa = Ala Cys Pro Cys
HSDAVFTDNYTRLXKQXAVKXYLXAILN

SEQ ID NO: 1352 - protein, 28 aa, Artificial Sequence
  VIP analog
  MISC_FEATURE (11)..(11): Xaa = beta cyclic amino acid
  MISC_FEATURE (14)..(14): Xaa = beta cyclic amino acid
  MISC_FEATURE (18)..(18): Xaa = beta cyclic amino acid
  MISC_FEATURE (21)..(21): Xaa = beta cyclic amino acid
  MISC_FEATURE (25)..(25): Xaa = beta cyclic amino acid
HSDAVFTDNYXRLXKQLXVKXYLNXILN

SEQ ID NO: 1353 - protein, 31 aa, Artificial Sequence
  VIP analog
  MISC_FEATURE (11)..(11): Xaa = Ala Cys Pro Cys
  MISC_FEATURE (14)..(14): Xaa = Ala Pro Cys
  MISC_FEATURE (18)..(18): Xaa = Ala Cys Pro Cys
HSDAVFTDNYXRLXKQVXAKKYLQSIKNKRY

SEQ ID NO: 1354 - protein, 31 aa, Artificial Sequence
  VIP analog
  MISC_FEATURE (14)..(14): Xaa = Ala Pro Cys
  MISC_FEATURE (18)..(18): Xaa = Ala Cys Pro Cys
  MISC_FEATURE (21)..(21): Xaa = Ala Pro Cys
HSDAVFTDNYTRLXKQVXAKXYLQSIKNKRY

SEQ ID NO: 1355 - protein, 31 aa, Artificial Sequence
  VIP analog
  MISC_FEATURE (14)..(14): Xaa = Ala Pro Cys
  MISC_FEATURE (18)..(18): Xaa = Ala Cys Pro Cys
  MISC_FEATURE (25)..(25): Xaa = Ala Cys Pro Cys
HSDAVFTDNYTRLXKQVXAKKYLQXIKNKRY

SEQ ID NO: 1356 - protein, 31 aa, Artificial Sequence
  VIP analog
  MISC_FEATURE (11)..(11): Xaa = Ala Cys Pro Cys
  MISC_FEATURE (14)..(14): Xaa = Ala Pro Cys
  MISC_FEATURE (18)..(18): Xaa = Ala Cys Pro Cys
  MISC_FEATURE (21)..(21): Xaa = Ala Pro Cys
  MISC_FEATURE (25)..(25): Xaa = Ala Cys Pro Cys
  MISC_FEATURE (28)..(28): Xaa = Ala Cys Pro Cys
HSDAVFTDNYXRLXKQVXAKXYLQXIKXKRY

SEQ ID NO: 1357 - protein, 31 aa, Artificial Sequence
  VIP analog
  MISC_FEATURE (15)..(15): Xaa = Ala Pro Cys
  MISC_FEATURE (18)..(18): Xaa = Ala Cys Pro Cys
  MISC_FEATURE (25)..(25): Xaa = Ala Cys Pro Cys
HSDAVFTDNYTRLRXQVXAKKYLQXIKNKRY

SEQ ID NO: 1358 - protein, 31 aa, Artificial Sequence
  VIP analog
  MISC_FEATURE (11)..(11): Xaa = Ala Cys Pro Cys
  MISC_FEATURE (15)..(15): Xaa = Ala Pro Cys
  MISC_FEATURE (18)..(18): Xaa = Ala Cys Pro Cys
  MISC_FEATURE (25)..(25): Xaa = Ala Cys Pro Cys
HSDAVFTDNYXRLRXQVXAKKYLQXIKNKRY

SEQ ID NO: 1359 - protein, 31 aa, Artificial Sequence
  VIP analog
  MISC_FEATURE (14)..(14): Xaa = Ala Pro Cys
  MISC_FEATURE (21)..(21): Xaa = Ala Pro Cys
  MISC_FEATURE (24)..(24): Xaa = Ala Cys Pro Cys
HSDAVFTDNYTRLXKQVSAKXYLXSIKNKRY

SEQ ID NO: 1360 - protein, 31 aa, Artificial Sequence
  VIP analog
  MISC_FEATURE (14)..(14): Xaa = Ala Pro Cys
  MISC_FEATURE (17)..(17): Xaa = Ala Cys Pro Cys
  MISC_FEATURE (24)..(24): Xaa = Ala Cys Pro Cys
HSDAVFTDNYTRLXKQXSAKKYLXSIKNKRY

SEQ ID NO: 1361 - protein, 31 aa, Artificial Sequence
  VIP analog
  MISC_FEATURE (14)..(14): Xaa = Ala Pro Cys
  MISC_FEATURE (17)..(17): Xaa = Ala Cys Pro Cys
  MISC_FEATURE (21)..(21): Xaa = Ala Pro Cys
  MISC_FEATURE (24)..(24): Xaa = Ala Cys Pro Cys
HSDAVFTDNYTRLXKQXSAKXYLXSIKNKRY

SEQ ID NO: 1362 - protein, 28 aa, Artificial Sequence
  VIP analog
  MISC_FEATURE (7)..(8): Xaa = any beta amino acid
  MISC_FEATURE (15)..(15): Xaa = any beta amino acid
  MISC_FEATURE (17)..(17): Xaa = any beta amino acid
  MISC_FEATURE (19)..(21): Xaa = any beta amino acid
  MISC_FEATURE (25)..(25): Xaa = any beta amino acid
  MISC_FEATURE (27)..(28): Xaa = any beta amino acid
HSDAVFXXNYTRLRXQXAXXXYLNXIXX

SEQ ID NO: 1363 - protein, 28 aa, Artificial Sequence
  VIP analog
  MISC_FEATURE (7)..(8): Xaa = possible beta amino acid or cyclic beta amino acid
  MISC_FEATURE (11)..(11): Xaa = possible beta amino acid or cyclic beta amino acid
  MISC_FEATURE (14)..(15): Xaa = possible beta amino acid or cyclic beta amino acid
  MISC_FEATURE (17)..(21): Xaa = possible beta amino acid or cyclic beta amino acid
  MISC_FEATURE (25)..(25): Xaa = possible beta amino acid or cyclic beta amino acid
  MISC_FEATURE (27)..(28): Xaa = possible beta amino acid or cyclic beta amino acid
HSDAVFXXNYXRLXXQXXXXXYLNXIXX

SEQ ID NO: 1364 - protein, 19 aa, Artificial Sequence
  VIP analog
  MISC_FEATURE (1)..(1): Xaa = any non-natural amino acid
  MISC_FEATURE (3)..(3): Xaa = any non-natural amino acid
  MISC_FEATURE (6)..(6): Xaa = any non-natural amino acid
  MISC_FEATURE (9)..(9): Xaa = any non-natural amino acid
  MISC_FEATURE (11)..(12): Xaa = any non-natural amino acid
  MISC_FEATURE (18)..(19): Xaa = any non-natural amino acid
XTXLRXQLXAXXYLQSIXX

SEQ ID NO: 1365 - protein, 19 aa, Artificial Sequence
  VIP analog
  MISC_FEATURE (1)..(1): Xaa = O-methylated tyrosine
  MISC_FEATURE (3)..(3): Xaa = ornithine
  MISC_FEATURE (6)..(6): Xaa = alpha-aminoisobutyric acid
  MISC_FEATURE (9)..(9): Xaa = amino butyric acid
  MISC_FEATURE (11)..(11): Xaa = alpha-aminoisobutyric acid
  MISC_FEATURE (12)..(12): Xaa = ornithine
  MISC_FEATURE (18)..(19): Xaa = ornithine
XTXLRXQLXAXXYLQSIXX

SEQ ID NO: 1366 - protein, 6 aa, Artificial Sequence
  Anti-Flt1 Peptide
GNQWFI

SEQ ID NO: 1367 - protein, 28 aa, Artificial Sequence
  VIP analog
  MISC_FEATURE (11)..(11): Xaa = ACPC
HSDAVFTDNYXRLRKQLAVKKYLNAILN

SEQ ID NO: 1368 - protein, 28 aa, Artificial Sequence
  VIP analog
  MISC_FEATURE (14)..(14): Xaa = APC
HSDAVFTDNYTRLXKQLAVKKYLNAILN

SEQ ID NO: 1369 - protein, 28 aa, Artificial Sequence
  VIP analog
  MISC_FEATURE (18)..(18): Xaa = ACPC
HSDAVFTDNYTRLRKQLXVKKYLNAILN

SEQ ID NO: 1370 - protein, 28 aa, Artificial Sequence
  VIP analog
  MISC_FEATURE (21)..(21): Xaa = APC
HSDAVFTDNYTRLRKQLAVKXYLNAILN

SEQ ID NO: 1371 - protein, 28 aa, Artificial Sequence
  VIP analog
  MISC_FEATURE (25)..(25): Xaa = ACPC
HSDAVFTDNYTRLRKQLAVKKYLNXILN

SEQ ID NO: 1372 - protein, 28 aa, Artificial Sequence
  VIP analog
HSDAVFTDNYTRLRRQLAARRYLNAIKK

SEQ ID NO: 1373 - protein, 31 aa, Artificial Sequence
  VIP analog
  MOD_RES (1)..(1): ACETYLATION
  MISC_FEATURE (17)..(17): Xaa = Noraleucine
HSDAVFTENYTKLRKQXAVKKYLNDLKKGGT

SEQ ID NO: 1374 - protein, 31 aa, Artificial Sequence
  VIP analog
  MOD_RES (1)..(1): ACETYLATION
  MISC_FEATURE (17)..(17): Xaa = Noraleucine
  MISC_FEATURE (21)..(21): Xaa = Noraleucine
HSDAVFTENYTKLRKRXAAKXYLNNLKKGGT

SEQ ID NO: 1375 - protein, 9 aa, Artificial Sequence
  PYY fragment
YPAKPEAPG

SEQ ID NO: 1376 - protein, 19 aa, Artificial Sequence
  PYY fragment
YPAKPEAPGEDASPEELSR

SEQ ID NO: 1377 - protein, 6 aa, Artificial Sequence
  PYY fragment
YYASLR

SEQ ID NO: 1378 - protein, 8 aa, Artificial Sequence
  PYY fragment
HYLNLVTR

SEQ ID NO: 1379 - protein, 36 aa, Artificial Sequence
  PYY fragment
YPAKPEAPGEDASPEELSRYYASLRHYLNLVTRQRY

What is claimed is:

1. A composition comprising a peptide comprising the amino acid sequence HSDAVFTDNYX$_1$RLX$_2$KQLX$_1$VKX$_2$YLNX$_1$ILN (SEQ ID NO: 1346) or a pharmaceutically acceptable salt thereof, wherein X$_1$ is the beta cyclic amino acid ACPC and X$_2$ is the beta cyclic amino acid APC, and wherein the peptide comprises at least two contiguous patterns of $\alpha$ and $\beta$ amino acids comprising $\alpha\alpha\beta\alpha\alpha\alpha\beta$.

2. The composition of claim 1, wherein the peptide has increased selectivity to VPAC1 as compared to its binding to the VPAC2 receptor at the same concentration.

3. The composition of claim 1, further comprising one other active agent.

4. A method of manufacturing the composition of claim 1 or a pharmaceutical salt derived therefrom comprising catalyzing a reaction between at least one $\alpha$-amino acid with at least one $\beta$-amino acid of the analog.

5. A method of inhibiting secretion of TNF-$\alpha$ in a subject or treating pulmonary hypertension, primary arterial hypertension (PAH), pulmonary hypertension associated to post-ventricular septal defect, idiopathic pulmonary fibrosis, idiopathic pulmonary arterial hypertension, high blood pressure, CREST syndrome-Calcinosis, Raynaud's disease, loss of muscle control of the Esophagus, Sclerodactyly, Telangiectasia, Acute respiratory distress, congestive heart failure, chronic obstructed pulmonary disorder, asthma, chronic obstructive pulmonary disease, sarcoidosis, small cell lung cancer, autoimmune disease, inflammatory disease, sepsis, Hirschsprung's Disease, sexual dysfunction, erectile dysfunction, Parkinson's disease, Alzheimer's disease, circadian rhythm dysfunction, pain, colorectal cancer, hepatocellular cancer, elevated blood pressure levels, elevated blood glucose levels, elevated blood pressure levels, hyperglycemia, diabetes, insulin resistance, metabolic acidosis, obesity, Type I diabetes, Type II diabetes Multiple Sclerosis, osteoporosis, Sjogren's syndrome, pancreatitis, uveoretinitis, osteoporosis, female sexual dysfunction in a subject in need thereof comprising administrating the composition of claim 1, or a pharmaceutical salt derived therefrom, to the subject in need thereof.

6. A kit comprising the composition of claim 1.

7. The kit of 6, wherein a first container comprises the composition and a second container comprises a vehicle for administration of the composition.

8. A composition comprising a peptide comprising an amino acid sequence that is at least 96% homologous to HSDAVFTDNYX$_1$RLX$_2$KQLX$_1$VKX$_2$YLNX$_1$ILN (SEQ ID NO: 1346) or a pharmaceutically acceptable salt thereof, wherein X$_1$ is the beta cyclic amino acid ACPC and X$_2$ is the beta cyclic amino acid APC, and wherein the peptide comprises at least two contiguous patterns of $\alpha$ and $\beta$ amino acids comprising $\alpha\alpha\beta\alpha\alpha\alpha\beta$.

9. The composition of claim 8, wherein the peptide has increased selectivity to the VPAC2 as compared to its binding to the VPAC1 receptor at the same concentration.

10. The composition of claim 8, further comprising one other active agent.

11. A method of manufacturing the composition of claim 9, or a pharmaceutical salt derived therefrom, comprising catalyzing a reaction between at least one $\alpha$-amino acid with at least one $\beta$-amino acid of the analog.

12. A kit comprising the composition of claim 8.

* * * * *